United States Patent 8,781,750 (CELL-TYPE-SPECIFIC PATTERNS OF GENE EXPRESSION) - sequence listing, part 18

SEQ ID NO: 36500 - DNA, 384797 bp, Homo sapiens
gcggcggcggccgcggtggcagcgaaggcggcggcggcggcggcagtggcagtggccgctgcagccccacactccgccgccaaactggaggagcgacggaagccagaccccaggaggtgagcgcccggccccggcagctgccgggagggtcgatggggtccctcgctccaaggcggaggcgggcgcgggcccgggggccgattccgtagggcgcgcaggcggcctcagcgcgctcctgggagggagagagaggtcaattgcgggccgggcatcccctgagctgggcgcgggcggtgtgtggaggctgcttccgcggaaaagtattttttttccttcttagggtttagaggaagagtttgggtggtctgcttctccctcactgctaagtcccctgcgcgcaactgggcgtctttacgaggactgcggggccagttctgcggcgggctgggctcgggctcagtgacacgtgtgttgctgtgagcctgggtggtcgccctgtgaccaggcacctgcttgagaggaacacatccctaaacccatcacagggggagatttggggactcttggtgctaccgaggccgcggcccccacttcactgccagctccaggacggagcatttacatctctccctggcacgccaaaggcggggggtgagtcaggcagattctctgcaagtggcacacacacatttatttgcaatggatttggctaggggaggcataggttaaactggaatttctcttggccagcgacaacggagctctccctcaggtactgggcagcatgtgagtcttggcaaagagaggtgatttcttttttcttaagtgcattttactcagccgttgccagtccgttaataagtcaccagaggaaggcaggacctgggaactacatcagcaaaccgcagcaagcaccataaagacaaaagttcttatagaacaaaaagaaaaacttgaacttgacgtgaaagatggaggaagcagttctacctctcttctatcacttttttcagcgccctgtaaaactgtttttttctatccttccttccctctcaaggccctaccttctcagcataattgatcgcagcaagctctttccaacttgacactgaagagcagcgacccctttggcttaccctccccatttcttttcctggttcgcttcagtgccctggaaagttgctcctaatgagaaatcaagaacactgggctgtactaaacgctcattgtctcaaatcctgcagcagttcctttcctaagagacactgtgttgtactgtatttctcttttttcttgtatcttgggacttggagttgtaatactacctgaattaaattaattaaagtgtacattgctcatttgggcttttttttttcattgtgatttcagtagattcgtcaatgccattagaacaatattcagtagctttttatagccaatgtgatgtcttttgaaaacgtttctgactacagctctctttcttgtgtctttcatattagcatgtaaataatttacatggtcattttagtacttagactgaagatattagtataacttcattcaaaggaagtgtgcctgtttatttttctataacttttatagctgagaaaaaacttttactttcattttaaagttaaaagtactgataggattctggtctttgtggtagatcttgaaattgaatgatttgttttaactgtatcccacactgtcaagtaagatgacagagaaactctcatatatgtagatggagacaggaaagcagtaccactacattatgagctgttgaggcagagaacatttgtaggagtgggggtgacaaggacaagatgggatattttgatagtcccagccatgttaaaaaaactgaaaactaagaaacccccaacattttggatttaagtgtacttcagaatgagggttttggtgccatttgctcttttggggtcatttctggagacttaaaaacatacattagacaccttacccaatgagattgacagaatgtactctcagtttagattaatgtatttcttttagttcacgtagtcaatattaaataattttagatgtttgaatgttagtactatgatttcagtcttctaaatgattaagagacattttggatttacaaaaatgttgtgtgaaagaaataaaggcaatcagatttagaggaataatgcgatagaaatcgggtaacctttgggacaacttccagtaggccctgatggtaatctcatttttcgctgagtgctggcaggtacagttttgaggttctgatcccttgttccgataacaagagtgatatctggccatagcttacatcttaaaggaaaagacaacacttaaagaaatgcacactagctggtgaatcatgtaaataaacaggattccttgcctgcctctgtgagcgctgtagacctcatatgaggactgctattgttagaggagaagcgtcctgagagactctgctggacttaagtgtggcgagatacatatctgtttcttggagtttctttgtgtttatttaaaataatatgaatgaaatctaagaccagagttgatagataagattgggagtggaaagaacaaactgagaagaggaaaatctaatgatgattaacatttctaagtgtttttttcttgattgctaaatgaaggaatcagaatgcatgatttgatgggacaaaggaagctataagcagaacatggatctcagttgatgctgtttccaaggacaacctgtgacttatgaaatttatgtatttttagggagtcatttagcaaaatggataaagaacatccaggaagctagtaagactttacaaaactggatcttactacttttacataatgtaggaatcttagaggaaaggaggaataaagttttatttgaggtcagctaagttgtattccaaatacattttgcctttctcccaatatataaactcttgatacgtttgggtcacaaaaatggaaaatatgctgctgttcttctgacatgaagatgatctttttatcctcagtagtgcacagctttggttatttttccagcaatagggatggagtctcctttactcagttctgtctatgtatgtttacacacacacacacacacacacacacacacacacacacacacacagacacaactcatttgtagaggtggctgatttaattttgtcggaagccatattaactactttcgtaatacttctgtggcaatggcttttattgcatttggtagtctcagcagtgcaatgacatttctaacaagacattgaaaatacaatgagagccaggtgcagtggtcccagatactctggaggctgagttgggaggatcacttaagcataggagttcgaggctgtcatgtgctctaaaattgtgcccataaaattgctattaaattgtgcctgtgaatagctactgcacctcagcctgggcaacatagggagatcctgtctgtaaaaaatgaacaagtgtataaatgctaatggctttacttgctgtggcaaaggagagataaaactttttcttccaatcttcctaatgatgccaataattttattccttaatgataatgtcttacttgatgctgaatatagacggttccagacttatgatgttccagttaaaatttttcagaattacaatggtgtgaaagcattcacattcagtaggatctatacttcgagtactggtaacaacattctgtttttcactttcagtacagtattcaattaattacatgagctatccaatagtttatttgtaaaataggttaggctttgtgttagatgattttgcctagtaggcgaatgtaaatattctgaacacatttaaggtaggttaggctaagctatgatgtttggtaggttaggtgtattagacacatttttgacttgcaatattttcaatttatgatgggcttatcaggacataacccaccgtacatttaggagcctctgtactggaaaaagatagtggtagaaacagtaatgttgaaactatgtgcctctgtagttgtttgtgtaaaccaaaacatcatcttgttcttctttcctgaaaactaagtaaatataagggattgttatgcttattgagatgaagaggaaactatgacagagaactctgtatgcttttcttaaacttaactacaaattattggtggaggtaggaataagtattttaatcttttgactggtgatacatgtttgtcgaatgactgtcaatgaatgggtgaatgtccttttagtcacagcagaagatactaaagcagataaaagtttatcctgttttaaagtgatggtttccattttctgttggtaattctgctcagtagcagtgcccacttgccgcaactttatttcagtttctgcaatccagggagtatttcatgagagaagaattttcagtttgggtgtaccagttttagctaccatcttgagagctaacttttgtttttcatgtagaatgaacatagaaagaaattaagtgaaattaggatgttaaaggaaataaataaccaccaactgatattttggagttttgtatttttactttgtggatagttgtgtggaaaaggtatactccttgacttgaatttaactcgaatttctgtattagaaaccttaagaaagttgtaaataaaactcctagtatgcttttttggggattaaaaaaatcaatatgaataaaaatacaaaatgagaaaggagtatgttatgtttaacaccgctgtaatattctatgggtgacacaactagaaaaatctcttaatatattgaagacgtcttcttatttaagaggaaattggtgatttctttttttaaagtatattcactgattaatattcttcttaatactatttgcaagtaagtaaacttgtgggatatggacttctatgttagttaattctagctttggcctggagatctgatattcactgataagatctagtaacaacttcatctatttggaactcctacatttgtcatgttccccagcaaaaaagtctctgagcaggcaaaatagagggtaaaaaagtaaatacattaaaaagaattcactttactcctaggacatccctcagagtcagtttacttttaatacccatactgttctatgattgattataaagtttttaatcccatagcaaacagtaaactacaaagtagaagacgaaaatgggctttattggcaaatacatagaaaacattgaaaagtgcctgaaaacagcgtggtagtaaaggaagaggtagacagaagtaagaactaaagcaaacacagtggttgaggactatttagatttggactcttatagcatcacttcattacacccccttctccctcccccactttctcagctcttccttattttcccctcccctcttccttctgttaagtttttattgaaatacatatggtcagaaaattgtatgtcatcataccatcagtggacatctcagcgatttacctaagtgaacatgtccatataaccagtgccaagaccaaaatatagaccattgctggcatccggaagtctcctctaactccctcttcaagtcattacttcccaccaaggtaaccactctcctaatttctgagataatggttactttcacctctcattgaactttctgtcagttaattacacggtgtgtattcttgtgtgtgacttcttttgctcaacattatgttgtgagattctttcttgttttgtgtgaagcatcagtttattctcattgctacatagtgttccactttagaagaacgccacagtacatttatccattttgttcttgatttactaattttgtttgggttgtttccagtttttggccattatgaatagtgatgctatgagcattcttacgtatgtcttttggtgaacatgtcgccctgtctgtcgcccaggctggagtgcggtggccggatctcggctcactgcaagctccgcctcccaggttcacgccattctcctgcctcagcctcccgagtagctgggactacaggtgcccgccaccacgtccggctaattttttgtatttttagtagagacagggtttcaccgtgttagccaggatggtctcgatctcctgacctcgtgatccgcccgccttggcctcccaaagtgctgagattacaggcgtgagccaccgcgcccggcccatgtgggaatttcagttgtgtgttttcccagtttaattgatgggacggttttagtagatagtgccttccttcagaattggtgctaattcacattcctaccagcattgtgtgagagtatcatctaccccacatccttacaaaaggggttttgtatgtcttttttttaaaaccattctatcggatgtatagttgtatcacagtgtagttttaatttgcatttctcagagtaccttgtctatcttttcatatgattattgtctacactttttcgtaaagtacttgttcatgttttttgctcctgaagtttttatccagtatcttttcccaagtaacgaagattttaatacttggggagttcagttcttttatttgtttagaagactcagctaaccaggcaaactcattcaccaatgcttccacctgataagtaaactcatgggataaagagattacaaacattttgaacttgtaaagatgatagtctggatcttcgaaactttatccctaaaaaataaaaaacccaaaccaaaacaatattaaataactttaatacagtactcagaaacatgcagaacttgtcctcaatgctttacataaaagtagagcatcttgtaatgttgtattgcccaatgaccaatggagatttgtatttggaaggtatgaattgaacatctagctctcttacttattagttgttttgagaatttaaaaaacatccgtgtcttttttcattattaaaataattataaaacctcattcacagaggagttatgaggaacagataaagtgatctttatgaaatcttgttcagcactgtaaatggccatacatgttagttattattattgttattgtattcttcaacattccttattcttgagttgaattatgccagcactgagaacagttcctggcatattaataaatgtttgttggctgaatgaatgaacacatttaagtatctttcttaaaccgttactctgagtgactcaagctgtgctttatatattttttttctctaggacttttactttttattgctgaagctgagttggaaccaaggttcatcaagcatcatattgaaaaattgagtctaagagccagcagtttgagatcacccatttctatatagttcatattgaatttatgcctccaagtaacacacacgacttggagaacccttgaaaatgattacactgctcttcactccatgagtgatccccaaagcttacacattgaatatttttagcttctataattagaatggccacaaatttccagatttaaaatattacagtgggttctccagtgctaatactttggaaaccatgttttgtgtaaaattgaacattcaaggatgaagaatagctgaaaactggagcttttatagtaccttttcagcttaatataaataaggtgtttcacagatatgttgattataatatgaaagcaaacaacatacaccttatatacatttgtgtaaagcaacaattcttaaccctttgataggtctgattttcagctttggcttgatgttgtgactattcaaaaagtggtttggaggcatatcatttttatttttaaattaaatagaattaaaatgtgtatgatttttgttttggggaattacatgatcttcctttaaataacagtaggtatccctttgaaaaatcaggcttgcagcagaagaaacttggatttctatatagaaatctagttagattttcttacccaaagactgatgttcttttccttttttcctgtatttgagtttttttttttttttttttttttttaaagagcttatgggggtcttgggtgtttgctgccatcatttaagtatagctgttctgtggtactcagaatactgagcatgtaacattttacttcagaataacataagtcagtctacattttataaggacgtttacatattaggtagtataccttgtgtgcttgacgcaaatgtggccaatttagggtgatttagtggaaaatggaatcatctggtatagtaaacagcttttgttttctgttacagacataatgttaggaaaattgaaataaatacaaggggtagttatggtgaaccctgttaaactactgttttaaaaacagtgaatttcagaaaaatctcatctgttctgagtgatttcattcctttgagaagttaaactggctctttttaaaacaaatgcatccaggcgtgcctggttattgctttatttaaagctggaagcaaggctcctttcggttcttacttgacacatgggatttaaaaaacaagggtatactatggatttagggaaggatacctgtttaacaaataggattatgacaattaaactatctaaactgaactccaaagggaatgggattagctcttccatttcttgtgcccttcagcatggaaatctgttggccttattgaaatattcctaatgtctctaatacaaaccaggtttttgcaccttctaccccagaaggatcaggaatgaagtcctgaaagtgatatttggtgaaatatgttttgttctgagtgagtaatcagtgggaccatcagttaggctgaaagtttcatggaatcttgagtgttgatggctgcactcctgaaactctctccttgagtactgtgtgaccacagctgcagtgagacatcacagttgaactgcttcacaaattccttcaattcctttgacctctggagactctgtccttaggaatgtgagatgagcactcacgatgttagcagcgagtagggcctcatggtagggactttgctaaagtactaattacagttgctttggaaaatggcagagcattaacgattaagcagagacacgcagctcacacatttgcactttcacaggttgagctcctttgccagggaaaagggagaaggcggataggaaatgtctcaaaagatttagataaactagattagataatttctcttgaaaaatatattaagaaatgaaataaaaacaccactccaaaagcatcaaaagaaaatatagttcaaacacttacctatttttattgccaaaaccttaggcagtgaattctgcagttgaattgatcactttattgttttctgctttgcactgccctttaattgtttcatatgtgttcatgttgtctacacagtatactttcccatggtcctcacggtggccagaaaatgcttatttaatggagggatacttagtatttttaaaatgtgtactggctgggtgcggtggctaactcctatagtcccagctacttgggaggctgaggcaggagaatcgctggaacctgggaggcagaggctgcagtgagccgagattgcaccactctactccagcctgggtgacagagcaagactctgtctccaaaaaaaaaaaaaaaaaaaaaaaaaaaaaaaaaaaaaaaatgcagacagaccagagatgccaaattatcttatccaactttatttaaactgtatttctggctgggcacggtggctcacgcatataatcccagcactttgggaggccgaggtgggcggattgtttgaggtcaggagttcaagaccaatctgaacaacatggcgaaaccccatctctactaaaaatacaaaaattacccaggcatggtggtgggcacctgtaatcccagctacttgggaggctaagacaggagaattgcttgaacctggtaggtgggggttgcagtgaggtgaggtcgcaccactgcactccagcctgggcgacagagcgagattccgtctcaaaaaaacaaaaacaaaactgtatttcttctggagatattcctccaatgcagtagctgtgatcattgctattaggctttttacatactttttgtgaaattcattgtaatgaagtttggaacccatatctttggggatgagtctttgttattatggtttgtgatatgttatagtttcttggaaaaattaattaacttattttgatatgactgtatttgatctgttctttgagttggataaattttacttattgattatttgagattaaaaatgaattgttagcagttttataaataactttttgtttttaaacacaggctcactagaagttgcaaaaatacagtgcagagagtttttctgtatgctttacttagcttcccccaatgaacaccactttaaagatgcctaaaaaggcctttacctaatgggtgcagcacaccaacatggcacatgtatacatatgtaacaaacctgcatgttgtgcacatgtaccctagaacttaaagtataataataaaaaaaagatttataaggaatagcaatttttatacttgctctgaagaaatatgtatttattaatcactgattatatgtataaccacagattataaaaaatagaattagagacacctactaactctctattttggggggttgtgggtttccgttggaaaaggtgctcatgtggcaggcaagaaggaagagtcattcattcacttatttattcatatctctgtgaatttggtgtttgcctcattcaaatcatttaaaaaatatttatcatattgattacattgaactaagagtttgaagtccaaatgttgttcctataaaatctttggaaaatagaatgcaaataaaagtgaatgagagtagaacttctttatggtacaggtattagggcagcatgataacactggattttatgtaaaggtgagagaatatcattgttctatacatctctgttaggtgcatgtcattaccttacaatatatgtgaaagcacaatatattgagacgttttagaacagatgtttcatttattacatatgcataatatttccagtgaaatctcagtgtttcactactccttaatatattgataaatattacacttgaacatgcatttgagttcaattatctcttaataggaatatttaagtgctatatttctatgtttgtccatgtatctgaactttatgcagtcttgtctagaatattcctttgagggtttggtcttgcacctcagggcagatgtaactgggaagggtctagagaaacacgctgcatatcatgagaatggaggagtttctttaagagaacacacagaaagttatttgaatgcttagggtcttgaacaatgaagtgtaaagtctgaaaggagacctcaccaaagcctgtaatggtcatgaacacttaccccaaatccaagaatatcagaactaggagcaccacatataagagagaaataggctgggtgcctcatgcctgtaatccttgtgctttaggaggctgaggcaggaggattgcttgaggccaggagtttgagaccagcctgggcagcatagtgagaccctgtctctacaaaataaaaaataataaaaaaatacataactgagagaagtaggtttagcttaaatttttaaaaagtttaagtttatacagtgggtatttatgtgagcagatgtttttaccacaagaggagaaactggatactctaacaggagaaggtccagagcaaatcactgggtggattaagtatttatacaatttaaaagagaagatggacatttggtaaatagacctaatcttttgggtggttattctctctttactcaagactttacccaggattatcctcttttcacagaactttcttcaagtcacttatcattttgtagaataatttcctgttctttgatgtcgtcaggtgtcactgaaagttggtctagaggattgtgggtctgaccgcacatgacagttcctataaagtttactggcctcagcatgtcttatctcagctcttgaccttgactggaaggcactagtgtaaatgcattgttacatttgaggttataaaataagcacttagacttccttatacaatttctatgaaacaagtccacaccttgctactgataacatgaaattggatgttatttctgaattgaaaccaacatttttggtttggggtttatctggtataatctcactactctgaaaaagtttacttttccaaataaatgcaatatattttattttgggtgagtttaaaaatcatcatcttggatagcttttttaaatgtaatactgtgtatgcaaattaaagagcctggaaagtctggtgccatgtattcctgtttggcctacagcttttagcttgtgtgatagatggattctgccacatgggcttgaacaacacagtgtcctttttttatttttatttttattttttgagacggagtcttgctttgttgcccaggctggagtgcagtggcgcaatctcggctcactgcaacctccaacctcctaggttcaggtagttctcctgcttcagcctcctgagtagctgggactacaggagcgcaccaccatgcctggctatgttttgaatttttagtagagatggagtttcaccatgttggccaggctggtctcgaacccctgacctcaggtgatccacctgcctcagcttcccaaagtgctgggattacaggcgtgaaccactgtgtccagcccacgagtcttttatataaaaaccagaacagcaggaaaaagcaggttagagcatgtggcccaggctgctacttgagttgacagctgatggaataaattcttagttctgtagagaaagtgaggatttagtccttaggtgattgtctggggatgtgggatctgacagaacccctatggcttggggagcaggggtgggatgatgtgaaagccttagtaggtactatgcagggtctgtggaatcaaggaagaggaaatcatattttgaggaggctgattgtgagaaactgtgaacctgtctgcttaaattacaagagtggcctgtttatctgctgtcaatagagtatgaagtagtcattttaattgaattttctgataattgaagcttattaattgtctaaaattatcttaagatattttctgatgtacatcattttaaaatgagttgcacacatttctattctgtttcaacatattcaatataattttcgctcttgttcatctgttggtattcattatataattcagacgtggtctcaggtctggagacatgtgaagttattgctcctacactgagtgtttccatgtcattatgccttaatccttatttagacacagctatgacaccctctttacaacataaaggataagcaaaaggatgtataaatgtatcctgggctggaaagtggcattattgactggccattggccatcagcaaaggggcctgagtggaaggatatgaaaggatgggtgtaatgtagatgacgggttgatgggtgcagcaaaccaccatggcaggtgtatacctatctaacaaacctgcaggttctacacatgtgtcccagaacttaaagtatagttaaaaaaaaaaaaggatgagtggtgagcacagctgacacaccccacgaatatctggggggctttgagaaggttgctgagatccagtaatcatgtggcaagtttcagttatttttattgagacctcttggctcaataggctgttgaggtcgttggaaactcccatcaaagttgttttccaaatcctccatgactgtcagggtttccctgtgcgagttaagagcatgagctctggagccagagagcccaggcttgaatcctgtctctaccattgtcttaggctgagttccctgtgaaacagtttgtgagattgtgcaagaagtttactgggacttgtactgagggacactacctgttggggagttaaggaagttggactgggaagagggaggagctgaagagcaagacagtaacagaggcctcagctgaacccatcaggagctctggagctggggagagagatcctttagagttgcccccagataaggaagctaggcctctttatcccacaacaactggtcatgatatatgggctgcctctggagaggggtgtgaccttgggtcagacggctctctttggctaaggtaatttctagaacaaggttgagctgagcgtcatcaatgaacactccaccagctggggaagcacctctgttctgcaggggagatctgggctgcacagcacagcaccaaagacttcgtgccttatgacgggggactctgtgcttccaagttctttatcccaaccttctttaattcctagagtttaagtaagttaatgaatgtgaaatgcctagaaaaatgcatagcacatagtcagtatggtttaggtgttcgttattatgatcatacctgactttatcagccctacctctattatagtgtggttcttctaatatgctgtgagtctgaaagctgttaatactctccttatttttttaaattttctttgcaagaggaaaacatctgacaatattttagtaagaaatgatttaacatataatgtgtttttgtaccatttgtgtttttaatttttaccagaagaaagatgcaaaagaagtgattactgatgatgacatttgaaggatttggacatatggtggataaaagttttaggagtatgtgtgtattagttgttggcctccctcaaagtaacttagataagcaatctctgagttaacagagagttcactgctgttgagttggagactggtgtgataagagcagttcataaccaggggatagtgtccagctgagaagctcctcgaagtgttggtcttcaactatcccatcactgtaggcctagatataaacattagaacatataaccaatacatatagcattgacagttaaattgctttatttcttaaacatttcagaatcattcatttccgtatttaaattccataaatatagagcaaatcacctggaatgttttagaaatttggttttgattcaaagtaatgttctcatggagatgcagtctctgccaattcatttctcattcactttaggacatggctaattcccttggacagtttttatctccttcatattcaaatgggtggaaaacattttatctgaaatgactcacccttcccccacctcctcaaatatggcaactatgttgtattgtttatttttaagggactatctaattgcaccgttaacattaaagcagagagttaaaaatgtatgccacaaaacactcttttaaaatatcaagtgtgaacatgtcttctgtttgtaccagtaatccattatttgtataccctaataaagccagcggagtggaggaggaaataatacaacaccttctttgaaaattttttttaaaaaagagggcttccttgaatccattttcctccccagttttaatttaaattgctcgtacttattctccatttcttttaaagaaatgagattgttagaaatgaaccatggaaagtaatttatctacatatttattatatgatgatctgtagaaaatgaggattacatggaatacacagtaatcatcaagctgtcaacaagaaattttgttttagcttaactttcttagacattaaccttgtttctgagttgagcaatctgttgtgggttctatgcagaattccatggttacttttgttatgtgagccaagaacctaatggaaatcttctcacttcagcaaccagctaacgttttttttcctattgagactaagaatatataacacatttaagattttagttccacattttggcggagggtggtgtttgggaagagtgaatatggataaaagatttgaggtagactactagatgtgtaaaaatgtattaatgtttatatatgatgagtggtaacaatgtattgcataacaagtcctttctccttttagaaagatgacttttaaaactgtgtatttaggggattaaaatacataaaccctctttttagagaaacattgttgagcttgatttaatgggaaacaactctatatccaagaagataatgctagtgtagcttttaattctcaaaaacctgaaattatgacattggtatagatgatctttcactgcgtaagagatagtgaagtaaaaataatattttggacaaaattatgtattgtgtccaaaatgggtgtaggtgaaatttctactcttgtatatttaatccgaagccagccacagttactgtgtgatgactttgcagagggtcctgctcatgactcccaatttaaaaaccacttaatgccctcttttttgttagcatgcatgtaggtaggtttttatgtggattttagttataccttggcgaaaaacatgcatttctcaatcttgggccattgacctaagttttttaaatgaataaatgcaaaccagaacatattgtaagaaggaaaatctgttgatccaaaacacttgtttatttaaatagaatggcttattactttcatttagagtataaaggttaatcaagtcttgggattgttcatctaaatatgtaaatgtaatgcggtcagggacacctgaataaatgtttgcttaaatgataactagttagtagaagtatattaaactagattttaatcactcacaaagttttacatgtgacatgtttagtaaactcactgtttattatgtaatttaagtaaaaggcagaagaggaaagatacctaataagcgaaacactgtaaattccagaaaagccatgttattagaatttatattttctctgaaaaccaagtagtttttcacccacaggtcactcaaaggtttatcaaaaggagaggaagattccatgcggtgttggctatttgatctaatggtctaaatgaaatggaaaaagaaaacatgtccttatgctaatggttcagtttccaacaataaacctggtgggttcactttaagtgtggtttcctgaaaattgatgatgatttttagcacttagcttcttatcttcaaagcactttccaaatgttaaataattaattgccacaacccccatgtgggcgtagaatagcaagcatgtctttctgtttaccaggaagccattatgacagagtctggaaatgttgatttttatttttagaggtgtctttgctttccaaggtgaccagcattttaaatgatgtcctggtttccaatcacagggtcatgggaaaagttaccaaggatgttgagtacttgaaaactttttattcttcttgtttccatacaggtttcacttttcatcttacttttgcctgttcatcattttgcaatactattttttaaaatggaatattaaatattagcaagtttagtctttgctattagtatagtctctttgtaactagtaaatacagcatgcagaaaacctggtggaactaggagggataaagataactttaagtggaaaaaaaatcacatttcaaaaacaactttaatatattaaagaaatgaatcattttaaacaatagtttttctagtctaacttaaccttggagcctgaggaataatgaatatagaccatgtatatgtctaacagtgtatagttgcactgtatgacatatattgaggatgaacttatataaaacaactagagaacaagaaagacaatgagagaggctaatgtagacaaaataaatatggaataagatggctaacactggggttaacacgtacatcttaacactggatttaacgcatacatcctgaggagactgaggtcatgggtgatggtgtgacaggacctttaggaaggaggtgggttagaatttacaaggtaggtggtgactgtcctagcagacaatacctacattagccagactaattcccagcttgtttgtgttgccagcgtcagaatatctactgattagctctctggagagatgcaggatggagtcactgtggcagatgcagaaggctccccatccctcagcttctcaacctttgaaatagaaaagagccaggaccttactttgagagcagtcaatccctttatgctttgagaaacccaccagataacaaagagaatgctatggtgattatttctgatgaatgttgtttctttgcatacgattaacatctttaaaggcagagcagagttagatttcttccatgtcattttaaggaggtaaggcccccccatcccccaaatcagaagtgtcagctaaacacttgtctattgaatgcaggtatatcttcttcatcatgaagtttgagacccacagctgggcttcagagaaacccctcgatattgttgtatacagaatttgtatatatatttatttttttctggagaagtatgtccagcatatttatgacattactgaaactggggcatacacacaaatatttaatatttaatactgactaggttcccttatggaccacaaaacaaaaggtcagtttctagctattgactcctccaaaatttgaatgaaaataaaatgagagcctgtcagctgcaagacatcacctccaaaaaatctaatgtttttctcttatcagaaagatcagaaagtgcaatgatgcagtcaaaaccagtgaacatggctatttaactacagtacattaaatttggaaaggtaatgatcaagattattttatctaccatcagtcatgggactttcttactatcagatctagagagggtatgcccataaggataaggcaactttaattgtgcatttgtaatttagctcacattcaaacatgagtgctttgatagcctttttgtgggaaattgctcattgactatgtcgtagaacgcatttgggaagtaggataattctttgcctctctatagttctttccataagcaaagtagttattttcctgtaagtttgtatactaatttaatctttgttaataagaccacattttctgtgaaattttgcaaataagatcatgattataactcattaggggaaggctgatatttaaaggagtattggaatataagagaatcattaaatatggaaaacaagaccaaaagactagggtattttaattgaagttcattgttggtctttgaggtgtgagtgttcaataatctcatgaaactatagccacatttaaattatatattcatatatccattttatttttaggttacaattcacagttttcaacagatttccaaaaggctcatggccccccaaaatgttaagaattattggcttataatgtcagaattttataagtgcttatctaggaagaagccttccataattttgagaattttgctcaacttcagtaatttgaaaacaggtcattgataaagaataaaatagtacaatacagtggagttcaaaactgtttagttctgagtataatgctttatgaatatatattagacttgacaaatgtgtaagaagataagcaagaaagatcaaactgttaactccgaattataactgagggcctggggctgaatatatgggttgaaatctgtcaataatctgtgaatctcattaaaaccagtagttggaaccatttcactgatgaaattcacattcattttgattattattattattattattattattttagaaggagaggtttccgaccctagtgattggtttggggtttcatttcctctactataatcatctactgcaagcgaatcatgcagtggttaagtattcagcctctggaatcagcttggacgatcatattactttgctactatgactgtggtcttggggaattcacttgacatccatgtgctcctcttctgtaaaataagcataatggtactagtaatcttataaggttgtaatggaaaatcaaatactgtagtgtatattgagaacagtaccacctgtctcaactgaataattttaattttgtcatcatttctgaagtgatgcctgctcataagatagataagatactggcagctgaaaggacaataagaagaaatgaggtgttggctctattccaaacactatggtcccttgaataaatgagaattgacgatttgttttattgacactagtctgaagtctcctggaaatgtttcatctgctttagtatgtctagacagatggtcttcctgcatagaatatttctatgtttattaattcagaattagaacaatttaaaaatctgtaagcatgtgtgaggataaatttatagcatgtgcttccatatccttaaagcaaagtatatctataggtgcaaattactgttgatcttaacaactatgatttcccaacatttggtgggtatttaactttcacttgtttacaaaaaaactaaatgaagtcacttgactatgaaatacactttaaaatattgaaatcagatagccttagatgataatttttctgcagtggtaaaggaagtattggaagtgatgcaaaatttgctacttcacattctccatcaattacttcatggtttttcaagttaatttgtatttctaagaactgcatgaaggcttattttctttgtgtagaaaaatattaatgcttgaattctgttttttcctctttattttcatttgagtttaggaaatttttggaaggctttcctcctttttcttcggggagacaggggctcattccattgcccaggttggagtgcagtagtgcaatcatagctcactgcagtctgcacgtcttaggctcacgtgatcctcccacctcagcctcctgagtagctgggactataggcacgtgctaccttgcccagctaattttagtttttatagagacagggtcttgcttgttgcccaggctggtctcaaacttctgggctcaagccatccctctgccttggcctcccaaagtgctgggattacagatctgagccactgtgcctggctgctctcctcctttgacaaattataataatataacaatgttggctgggcgtggtggctcatgcctataatcccagcactttgggaggccgaggcaggcggatcacgaggtcaggagatggagaccatcctggctaacatggtgaaaccccatctctactaaaaatacaaaaaaatttgccgggtgtggtggcgggcacctgtagtcccagctactcaggaggctgaggcaggagaatggtgtgaacccgggaggcggagcttgcagtgagctgagatcgcaccactgcactccagcctgggcgacagggtgagactccgtctcaaaaaaaaaaaaaatatatatatatataataaaacaatgttactattacaggtatccagatatattattggctaatcattatctgtaaaatgaaaaaataattggaaataaaatgtggtattacacaatttatcacattatattaaaaggggcctacattagaatgtgtagaagcaagcctttttttttggtattaaaatctcataatctcatttaatgatttattaattatggttttctttcccattacggccttttcttttattgttgtcatctggactcttctattttaaatcacctttctttttatgattgtatgaaaaacaagttaacctagttaagttgggttctaagatgcctgaatcagtgtcccacaccatttataccatctcttgaggacattagatgatattcacgtgaccctcacttgagtgtaattcttgagccaggaccaaaggtttgacatgagatgaatatttctcagtttttttttccttgagtttccagacttgaaattggctagcaatcagctggaatatttggttatagagacaaatttggttacgctagaaacctgatctttagaatggctttatgctctttatgcaatgctgaaagtcttcagaaagtttgtgtcaaattttcttgcctttgtagtttattctgcatgatcagaataagtgtggcataagttactttatatgacaagggcacatattttttccccccatgctcaatataatatgcaaatcaaaaggaccctcatactatctgtgctattggctacagtgtattatgtctaacttttgaaatgaacagtggcatttttatttcatagtcatctattgagcactctgttaggatcttggaaaaaagaagcagcagggcacattcctccctaatgtgtaacagtctactgggggagacagggcagacacatttagaaacagaattctacaaggatgttgcaagaacagggtcaagtgaagggtgtctgaggttcacaggtgctgaggcttgaaacctttcttttcttcttcttttgaatacaacacttagatcacattgttgcagctaataaagatgtatcataaaatatgagtaccagtagctacctgtaatgcattttggagattttcattttattgtatctttcttcagaaaattatgagcatttcaatctgttagtactctgcagttgcatatcaattggactcaaattgctcaatctctgattttcagacctatttatttttttccttcctgattattgtgagaaatacttcctgagtattgtgagaaatacctttaaaacctaggttttaaaggtagctgactttgctattgtggtgagttatgcttaaaaattggaaaaataaattatgatgtatttttggattaactattatttacagttttcaggagattttagcactgtattttatttcatcattattatttttatttggttgtatgttatttggagggactgttccagtgctttttgtggtctaaccatgaaagtctctgagaattgaacatttatacacttttccggagaacgctgtgaccatgtttatctcttttttccttttgcttttcaccttagttgcctgtcttttgaagcctgccatgctggcaatgatatcacatatttctggtgctttttgtaactaccagtgtggacaccaatggggtgcccatctgagtagccctgggtgtcgccctgagctcacctgcatgttggcctgagcactgctggtattgtagggatagtcaatgattgcttcctttgggcaagcaggagctgcaaccccctgtgtaattttctaggcagtaagcaagggtgtgtttaccattatccttcttggctgtttaatagccattatctaatttaaggagaaatcacagcatctatgcaatctgtcaaaaaacatgatgacttaaacatacttaatgtatttctagaaccaaagtaacagttgccagaaatgttgaagaaagtaaatgtcttctctgagaaactttagtttgtgggcaatgcattgtatgtgttaaaatgcataatctttggtaatttttcaggaaacattttcttatcggttatttctcacaaaataacatgttatttgtgatttctctttctccatctgtccttccattccccacacttaccccaaggaaaatcttagggaaattaacacaactaaggagaaggctttcttcttgttactgggaacactgtgtaaacaaaatgatcagaagaatctcttttaaatcttgaaaaagtatatttgttggaggttgaagctatgttgttatgtttatatatttttctacctcagtagtctgtaatctcctgaatgaagtgtctgtatcttattcattttttatgtcatcagtctctagcatggactgatgcagagtaggtactcaataagaagttgtccaggagagctgaactggaggcatgcagctgcagttataaagatgaaaagtgatagagaaaaaatatttgctactcagaatttccaaagaattgtctgaaaaatgtgaaaagacttcgagccaaaatatgacaaagaaaactcgcattcagaatgtttttctttgtaatttgtcttggcaacatttattcctttgcacagatccatgtggttgttagattgctttcaaataatatcgttgtatgacagggtgactgcatatacttttaccacaaaataccttcacaaaacagtttatctttttataattaccttttgtcttttcctttacttactcctacagattttaggcttttggcagattcagaaaagatttatcttttatttgcttttaacaatataaagacatagtgattctcctatgattctgtattctgtaaatttaggtctgtcatcaccatactttatttaacatagagaattttttatatattacctgtgaaactccaaataatttgcaaaattaagatatcaaaatggtatatgatagctcacaccatgaggttgtttttaccaggaggtagaaggatactttgggtctgtaacacaaactactaacaataaatttctgtccatcctaattgcgaatataccagtttttaggagtgacctcaatgttgctgcactctgaagttttaaaaatgtgggtatgtttaacagctccccaatgaatctgagcaaaaacctgaagtgttggagctctgccctaatttggtggacagatttttcacaaatctttattgctaagaagatggaacatttgacaatttaaagtcatgtcccccataagttgagagtaaacacattagtaatagtgtcacttgaatttatctgttttttttttttttttttttgtgtgtgaacagcttataatgctttatggagcttatcaaagccacatggtgatgactgtcaggcctggagttgtgcaaaaatgaactttggctcttgcagcgaaggaaaattagacgctaaaaaccagggattttttttagaattacctaagacagggtttgtaagatttacaaccaaattcacggatgtgatgattgcagtgctccctcaccaaggaagccagccaactgtgaggatgtctcactggttgtgtgtgaagacaactaagatgccatctaagaaaatctaaccttccagccttggcttgtacaagtgtgtctgccctcaaagagtcattccagctttctgtcttctgtctgaaagaataatttaggtctaattttaaaattgtctaattttcccctaaaattttgagttctttatctctattgttactattctggggtttggaaccctctggctttttctctaatgggctgttcactgagcttaggtttctcacttggttagattcggggttagttttaatgtagtcaccatcctgtgttgaatcctcaggatcaggaatggatctaggcagaattatgtctgactgggagagtagccaggaagaggcccaggcctctggagctgggcagaaggtgggggttgcccttgctgggagcagagggtgaataccagtgctgacctgctgtcagaggggctcaccagaaatgagaaaaaccagatggtcactaagaccagagttggaatccacaggacagaggcacaatggggttggagaaccatgggatatgaaagtgtgaggggaaggttgagactagatgaatgagatgaggtgggccatattccacaatggcaatgacatttcctgtgtgcacgcgtttgtgtgtgtgcacgtgtgtgtgtgaatagggtagcaggtttagttttgggtaggccaggtcacattaaataaactggcatgggataggtactagggagctgagcagagtgattaccatgaggctaaagctcctctgttgctgggggaaagtgtccaaaggtgagagaagtaaatacagtcattccttgcataacgatgttttggtcaatgatgggccacatatatgacagcagtcccataaatttatattattgtatttttactgtacattttctatgtttagatacacaagtacttactattgtattataattgcctacagtattcagtacagtcatgtgctgtatgggtttgtagattaggagcaataggttataccacatagcctaggtgtgtaagaggctgtaccatctaggtttgtgtgagaacctctctgatgttcacacaatgacaaaattgacaaacgatgcatttcttggaatgtttcctgtcatttaccaatgcatgactgcataagacctgatgataactcagaattctgtattttcctgcatacagggtgttgctgatttgcatctgtttgtcccttcctttattgtcattactagaaataatgctggattttacctcataaagtattggctcatgagtgccactcttgacatgttacaaggagctggtaaagcagacatagagaagcctctgttcttatttttgagactaaaacacaagaaagctctgctttcaggctggtgggcttgaaagcaggggactcttttgtcaccacacaatttgatcttactggagtactgagttttcatggcatactaattgctctttattaagagtcatttctgtggctgtcattatgattgtgcaccttgatgtatattgatagagtaaaagatgaaaaggtgagaagaaaatctccctgatatggactgaatgtctgtatccaccctgacccccacccagagtcataagttgaagccctaatttccagtacgatgatatttggaagtaagacctttgggaggtaattaggttatgagggtggagccctcatcaatgggattagtgcccctgtaagaagagacatgcgagagatgatctctttttggccatgggaggacatggtaagaaggtggccttctgcaagccagaaaggaaggtctcaccaggaacggaatcagctagcacctggatcttggacgtccaagtcttcagaattgtgagaaataaatgtctgttctttaagccacccagtctatgatgttgtgttatagcagcctgagctgacaagacactccctgttctctacaccctacgtaggctgctcccttgcaatatttttatgcttgttcagttggccacttagcatcccaatcatttttcttgacatggcccccaggtacccagatgtactggggttttgtgtggagaactgaactgtgcacaggctacacctttggcatgaactgatcctgtaccgaggggtatagaagtgctcccagctgtggcctcctaacttggtttacacagccccgtatacaacacttcagaagtgtgtcatcctcagcctaggatgacgctggctaatggccctgtagggagggaagaggtttgaaagggaatgataattaaagcaacttcagttacattgtggattttctaggatttccaggtacatgttagcatttcctgatcaagaaagttggtgatctcaattctgttttccataaacgcatcatcatggcaaaggctgatggggcagagagacaggatatatgacccttgtatataacccagaagtcagggatgtggtcccgccaccactcgtaccctatcctacgtacataaaactgtcccatatctttactcttgcgggcttttgattttgttttgttgagttctgtgtttattttttgctgtgtacttaaattgattcaataaggcacatgatctgagcaaaaaaagaaagttggtgaaataatagatttatttactaatgtttctgaatctttttcatgtcacagagtgctcagtaaataataatatttgcatggtacactgggtaaacagtctggacatcttttggcctggggcttgggctctgcctggccctgcctggcagctcccaggagtgaggggcatctccacccacttgaaacttactccaaccctggtttagaaccatgaggattcacagttgatgcagtagtagctttatgcattatgcagctttatgcattctatactggcaacttgggttatgattttgcttttgctgtgatttcctagtgtgcttaggactttttgtctgaattatctgatctctaacccagagtcaatatgttacttatcttattagcaactaggcatgctgagagaataaataaattgtgtgtaactctttgagtatcttcaaagtaataccctatgctattacaacggtatcacaaatgttggatcacaaatgtcatttagtccatccttctgtcctctcctcaatcttgttgatagtacagggtagactaaaacatcacagctgggtttctttatttcccctgaatttattaattcgctcctgactgcttttttcttgttttgttttactaagaactttgtgttctggtcctgtccaaggtgcagatggttatgctttcaaaacaccttattgtcataatagcactcatttcaaataatactctactctcagtttcaccatttcaagcactattcatttgattcttgaggagaaggtgatgctcttccactgatcctccaggaagggtctgatcctccaggaaggctccatccacctcgttcctttcccaggttcataaggagggtggcagtgtcaaatgaaccctgtgccaggcactttcacattcagtaaggagagcatgggttttagagtcagacagatctaagtgtgaatttccatctcttcccttttagactctgtaacctcaggacattaactttatgattatgggactgtgtttcatcctatgtaaagtggagctagtggtaactactgggtgtgtgctgccgtgatgatcacaagtgaaccgtcccaaaggggctagcaaacagtgggtgctcaacaaacgatacatataattatcattattgataattctgtaatgcattgtacagagtcagttgttttaccgaacaaaataaattattattgcttgtctaccaactttgtcatttctatttttttttttttttttttgagatggagtcttgctctgtcgcccaggctggagtgcagtggcgtgatcttggctaattgcatcttccgcccccaccccggattcaagcaattctcctgtctcagcctcccaagaagctgggattacaggcgtgcaccaccaggcctggctaacttttgtatttttagtagagacggggtttcaccatgttggccatgctggtctcgaactcctggcctcaagtgatccacccaccttggccccccaatgtgctgggattacaggcgtgagccacaactcccagctatcatttctatttaagaaaccattcatttcagaaaattagttcttaccaaagatgtgttaactgaaataacatttttttcttgctttcattcctctgtcacttctatttttaatgtttcttttattctgatttttaaaaattggcatttggggtcatttttaagttttattcttgtcaaaaacattacacaaacaggtctgtatttcccagggtgaccacctttcaaaaatgcccagctggcccatttccatgcctcagccatgtgcccagttagtcctctgactattatcaacaagttgagaaatttgacctctgatatatcaagaggcacatgcttgatgatttctttccttgattccctgcaaggttcaaaagagggaagctcctcttatcctttatttttggcttccaccttggaactaataagcttagaaaagactttggaaggctatctggttatccctcctgctccatgctgaggagggagcatggcatggagcattggagtcagagctgggtttgaattctctctccgccagttgctagtaatgtgaccgtcataaacttgtgccaggtggcagcaatttgacctttatgaacttgtgcctgtctgggagaaattaaggacttgcggcatgacaatactagctacgtgccttgtctacctgctctatgctaagtatctaccacgcagggtgcttttgtgtctgttatcccatagcttctccacaactgaacaatgtgggtattactaagtccatttttcagatgagaaaatggaggcttagagagttggtaacttgaattacattcactttataaaaattctttactaattttgttttaaagaaactgtgtgagtgggacaagatgtggagaataagaattgagcaagaaataccactttagatttgctttgacattaaagtttttttttaaagcaatttaatccttactgagactgaataatatgtttctactaatgaatgggctgtcagctctaatgataaaacagtgcaaatcagcagtataatggagcaataaatgatttgggtactaacaaaatggcagttatgggctgggtgtggtggctcacgcctgtaatcccagcactttgggaggctgaggtgggcgatcctgaggtcaggagtttgtgaccagcgtggccaacatggtgaaaccccgtttctacaaatacaaaatattagctgggtgtggtggtgtgtgcctgtaatcccagctatttgggaggctgagacaggagaattgcttgaacctgggaggtggagattgtcatgagctgagatcgtgtcactgcactccagcctgggtgacagagtgagactccatctcaaaaaacaaaaacaaaaacaaaccaccaacaacgaaatggcatttatgtagcttagagagtagtttttatctgtagatgcttattatatggttgcttttcaaagaccattgtaaacaaaaatgattctatgactgtaacagaaataggaaactctcagctggtcatcacttctatttggtataagagtggcatcatatgtacttagctggcatttcctgattgactgttggtttttatagaactggaagcagaggcaggaagacttacaaaacagactctgaggtcttcatcaaggctggaatgtggtagtgacagtctgacatgcactgcttttggcttttcttcctttttggctttggctgaagctagtgagctggggggactgtgaaagttaaaacaaatggagagtgtagggaaagtgatctttgctttttctaagactcttcttggcaatgggacttttcttctgatatttacaagaagaaataattctttcttttttaatagtggcatgtaaagtgatccaagtaggtaatagttcataagcaagtcccaaatctccagaagggagatgtcatgatactgaacagctctttaagaagtgagtgatgttttactttggtcttcagaggtctgtgtttatccaaataatggagttttgagataatgagaaaagcaaatgcaaaaagttaccttagacaacatgcgtatgtaatttcttcttagagttggtttgtctcaactggttatggttaattttatttgtgattatctattagaggtaacactggtatttatgctctaatttcagtcacttgtttgatgacctttctaaacaaatacgtgtgctgcttccaacttaattttggaatgccatcactttatatttattatttagttgtttgaaactcaaaatgtatttcactgtagaaagcaatattagaatggtgcttagtgttccagacccattcaaatccgtacaaatctatttcacccataatatacctaaaacagtactattagcactataatattattagtaattttgatactgtgagctaataatctatatgggttgtatcacttagtagctgtgtgaacttgacaacttgcttgcatctttaaatctcagttttatcatctgtaaaagggggatgataatagtagcagctatttcattgacgagtagtcaagcttaaataattcatataaagcacttattatattaaattttattattatttctataatttggccacattttcagaaaattgaactttgtgagttggccttggaacctaagcaacaaatgtaatattacttccttgggaaaaataggtatcctgtgtttggcaagaagggactatgctgtcactgggaacatccttcttcttcttttcccttgtatcccatcaatgtctagtaatacaagggactgtattagtttttggagagtttttattcttctaggatcacagggaagctcacttttctgcagaaacatcacaagagcctctaagtgttcaagtgaaaggaagagtagcacgtctctcactttaagttaaaagctagaaatgattaagcttagtgaggaaggcatctcaaaagccaagataggtcaagagttaggcctcttgccgcaatcgttagttaagttgtgaatgcaaaggaaaagtgcttgaagaaaattagaagtgctactccagtgaatacaccaatgacaagaaagtgaaaacaacccttaagatttatgctaaatctcctctgcctatgctctgaagatggaacagcacagcctagataacagtacatctgtttatagcatgatttactgaatattttaagctcaccgttgagacctactttcaaaattttgctgcttattgacaaagtgcctggttacccaaaagctctgataaagaggtacaaggagatgaatggtggtttttatgtgtgctaaaataactttcattctgcagctcatggatcaaggagtaatttcgactttcaagtcttatatttaaaaacacattttgtaaggcaatagctgtcataaatagtgatttctctgatgggtctgggcaaagtaaattgaaaaccttctgaaaaggatttaccattctagatgccattaaaaacatttatgattcatgggaggatgccaaaatatctacagaaacagaagtttaagaggaagttgattctaatccttatgggtgattttgattcattacttcgatggagaaagtaactgcagaagtgatggacatagcaagagaactagaattagaagtggagcctgaagaagtgactgaattgttacaacctcatgacaaacttgaatggatggggagtcacttctcatggatgagcaaagaaagtgatttcttgagatcgaatctgctcctggtgaagatgctgtgaacattgttgacatgacaacaaaggattgggattcagaatattacataaacctagtcgataaagtagcagcacggtttgagaggattgactccaattttggaaaaagttctactgtgggtaaaatgctgttcaacagcaatgcatgcaacaaagaaatactttgtgaaaggaagaatcaattgatgaggcaaactttattgtccatcagagttgaggcaagaccttccactagcaaaaaattacaacttggtgaaagctctggtgattgttagcattttttagcaatacagaattttaaaattaaggtatgtgcattttttagacataatgctattgcacacaatagacaacagtgtagtataaacgtaacttttatatgcattgggaaacaaaaatttcatgtgactcgctttattgtgatatttgttttattgtggtggagtggaaccgaacctgcaacatctctgacatatgcctctaaagacattaaaaatatatataacctcaccaccattatcatacctaatacaattaataataattccttagtaccgtctaatacccaattaatatccaagctttcttgattgtctcaaaatagttttttaaacagttgatttgtttgaattagcatctcaacccatgtgtcacattagatagttatgtcttatgggtgtcttttttctctcagagttaaggagagtgtttttattttattttatttattttttttaacttttattttaggttttgggggtacatgtgaaggtttgttacataggtaaacgcatgtcatgggagtttgttgcacgtattatttcatcacccatgtattaagcccagtacccaatagttgtcttttctgctcctctccctccttccacactccccgctaaagtagaccccagtgtctgttatttccttctttgtgttcataagttcttgtcatttagctcccacttacaagtgagaacatgcagtatttggttttctgttcctgggttagtttgctgaggataatagcctccagctgcatccatgttcctgcaaaatacatgatcttgttctttttcatggctgcatagcattccatggtatattggtaccaccctttctttatccagtgtcattaacgggcatttaggttgattccatgtctttgctattgtgaatagtgctgcagtgaacattcatgtgcatacgtctttatggtagaatgatttatattcctctgggtatataccgagtaatggaattgctgggttgaatggtagatagttctgcttttaactctttgaggatcaccttactgctttccactgtgaaggacagtgtttttaaattgggatgtaacgtccttccacaatgtggaccactcctgtttgtacaaacaagtggctagaaccaaacacgggatgtcattcttatggcaaaggatgacaagctcagggcattttcccccaaagtgcagtcagtgtaaccatggaatcagaaaactcatagtttaaaacaactttaaatgtattccttttttatttaaggtatcaatttgaatcgtgggtgttaaaaaaaaacaccaacaataagctctatgctattctcatgatatccacatattaatcatctgctttggcatcttctagcactacgtgttgccatccctggggcagatttaggtaggcgaggtttcaagtggcaacaacttgagtcatgaactttggagctagtttggcagaagttgataaagattatattaacaagttaatgcagattggcctttgtcatgagcactgaaacattgctcagcaccttcacaaggcagaagtcaaggtcaaggctctgaaccctcgggatgaagtctcctaaggtgtgttgattcatttttggatctgcagaggattgggtcaagttctgacatggtgctgtaggattctgatccagcagaccccacctgtaacctctgtgctacactagttgtggccccagaaagaccttctaagcaggtttcaggaagcaccttaatggaaatgtttatataatgacagagacttaggtaaagactataagctcgaggaagtatcactctattgcttagaccatccagtggctttctagttgttcagagtaagcactaaagcccttcatacagtagccttccagacccaaagcagcctgcctctcctttaccttcacctctctgattttatctccagccctcctgactcactctgcaccacctactggcctccttgatgttccagtaatcttcctggctatttcctgcctcagggcctttgcatttgctgttctctcacataactgcaagtctcacttccttacccttttcaatctttgatcaactatcactcgttgaggcctttcttaactacctatttaaaactgcaccactacccagtttaaccagcattccctaaatctcttccttgcttacatttttccattgtagtatcaacttttaacacattatgcaacgatttttaaattttgggtattgtctatttcccaccatggattcatccttcgtgcctagaataatgcctagtcatagcagacactcaataaattgaataaatgaatgagtaaatgaattaaactttggaaaattagatcacaagtgtacactgagagatttcttgggaaaaatgaaggataaactttgaacagcattgtggaaagagacattttaataagggaacacagactagagaaatgtcttcaatgttcttgtaatagtgaactgtgctcataaagtttatgagataaaagttgtttttctgcttagtagtgcagcccacgtggtgagtgatgcactcttctggcttttgatacagtagttccttggcatgtgtgaatttaacaattgtgatttcaactatttgctagcagccctagagggtcataccatgtagtgggtttgtgctttggtggacaaccatgtggccaagtggtgagccgaggctgagctggcagatggaaattagatgctgtgtgatacttgtgaattggggaatttgcaaaatgggcctggggaggggatgttcatgaatgtcaagggtctgtatactctttaattattcagtgagtctactctttcactaaaggtctgtttaatatttgtgatcccaggttcctagagtttttatttttgtttttgttttgcactgatactctttttttttttttctgagaccaagcctccctctgtcgcccaggctggagtgcagtggcgcgatctcagctcactgcaagctccacctcctgggttcaggccattctcctgcctcagcctcccgggtagctgggactacaggcacccacccccgcgcctgtctaattttttgtatttttagcagagacgggttttcaccgtggtctcaatttcctgacctcgtgatctgcctgcctcggcctcccaaagtgctggttttacaggcgtgagccaccgtgcccggcctgcactgacattcttttatttgagatgcagagatctgtgctcaatcagggttgagtggaatgggatttaaagaacttatcaagtatataactgagttcaaacagttcaaactattttcaactttacatctgattcccaagaatgaagcagaaaatgaagatgcttgcatgtgggcctcctagattgagtatctggcacaagaaaagcctgcccaaagccaagtaggccgccatttccctttcctttgtagggtgatctcacatccatggtcccttagatccaatgcttttaggagctcgggtcctcacagccctgttccgagactcatgaactcggagtctcaaagcccagatcccattcccacagaagcccgtcttcactgcccgcttctgttcccttccgaactcagattttctcagtctgcttctgcccctcaggaacctgagtcttcgtggccccgtttctgatccttaggagcccggatcttcactgttcctcttctgccacttaggagcccaggtcctcactgccccatttttacctctccggagcccgtgtcttcacacctcattcctttccggtcctctcctcttaggaatgcgggctctcacaatcctgttcctcccagacagatttccctcagatactggagaactcacatccatagccgttccctaagtcccgtctggagcccgggtccctacagccacttcttctctgagcctgatcctctcagtcccttcccaagagcctgaatcctcacagcccatctcatccacaacctggtcctgcgaacactgacccactgtaggtgttggtcctgacttcctcctcccgctcttgttcctcaactgccagagctcaagactccccaagatatttggagagttttaacagatcagtcgaattggctaaaaagaggcagcttgacattgagtgggtaagagaacagattttggagctagtcctcctgggtttgaatcctgacatcaacagttatagccatgtggttttttttgggaatgtgacttaatttctctgtatttcagatatgatggtgataaaaacagtacaaatctcatgggattgttgtattaaatgagctaataatatttgtaaagcaattacaatagtaactaagacatagtaagcactacctaagtgtttgctaaataaaaataaagacattgatttgggggggattgctacaggatgctccggtctttggccagtaggcacaccaaagtggggaaagaggtaagtgatgtaatttgaaattataagaaggcatatatgtatgaagaaatattcttgaagataatccttggtgggcattgattagttaattatgaaagagtatagtagagtggttaaaattgtggactgctaaattagtctgcatgcctggtcttctcatcacatgtactgtgtgattttgggcaaattatttaacttcaaaattagaactttaaagtgggtgtgtgaaaagtccctacctcatggcattgtcatgaagattgaattaaataatcatcacgaagtatttagcttagtacttggcaagtagtaagtatttaaaatgtgactgaaaaaattaatagataatgggccaggtgcggtggctcacgcctgtaatcccagcactttgggaggcctgggtgggtggatcacctgaggtcagtagttggagaccagcctggccaacatggtgaaaccccatctctactaaaaatacacaagttagctgggcatggtggcgcatgcctgtaatcccagctacttgggaggctgaggcaggagaatcgtttgaacccaggaggtggaggttgcggtgagctgagatcgtaccactgcactccagcctgggtgacagaacaagactccgtttaaaaaaaaaaaaaagataatgaaagtccctaatctcagttcctacattgttataggtattgacatcctttagctagaaccttcagttctttccctgttactgagtcagataaaataagatggcatccagaaggaaataatgcatgtatgttgcttagcacactgactgacatgtagcaagaacttaataaaatttcaggagcctcatccctgccagctgggtggtggttcaggatgggagatgtgaacactgtggttgccatgttgggtagaggtaggaaggtttgcctaaacccgtttcagaaggcatcttctccaatgtcagctgtgtgtgtcagaggtgggtgggtcagggggctgtacatgatcaggtgccatggagctgactcccagccctgtgtcctggaacaaactcctgctcttgagtccccatctgcctgccaatctgcatctgatctgagatcactgtgaaatccacagtaaatgtgcaaaagtcacagactacaatgaatatgaattaactgacgattttagttattcatgctattgccgtgctaattactacaaataatttatcactgactgtgtataaacataaaactaagctacaatttctagagcttaaggcttatattgacattttgaatcctaattttatttgcaggtagctgccatccagcttctttataggtttacctaaacacattacagagttttatttgtccagttgcaggcctgatgagcaaaattgaactttcttataactttcctgctgcttctgggtatttattatttttttttagagatagatctcactatgttgcataggccggagtgcagtggctattcacaggcacgattgtaacgcactacagcctcaaagctcctgggctcaagcagtcttcccacctcagccttcctagtagctgggactttaggcatatgccactgtgccaggctttgcttctggctatttaaagtagtttatggtgtgatttatttttaagttcattcattattctgttcgtggaacaaacttttatttagaatcaaatatgtggcaggtccaggtacctcttaatttcttttttagcagacaaggggaaattctcatttgaatttaatttgacccctacatttgagagtatagttatagtctgtgtggagagctaagatctaatgttagtctataaagagaaaattatatagttaaaaatatgcttgaaaaatcccttaattcaaccataaacataatactcttcagggagtatagcacagccattttcccccctttctttggaacaaatcactatttcttcagttgaataacaggctaagtaattggaaatttgcttgtttatggggtttatgttgtttgaaatacacattcagggcctttagacttacagatccacttaataccaaacatgcatgtgccctcactgtgcctatttctaactggttgattgactgatggattgattcatagtcactgaatcaattgattaattgattcattcatagtcactacacatagtcactacacatagttagtagactatgtgtagtgactatgcttgatactagaggtagaaaaacttcagaaagacagtatttgctctcaaagagctcataatgtggtggggacaagagccatgacatgcccaagtacagttgagtgatgataagttataatgacaatgcattgtaacgtgctatatgagaagcaggcacattcaggaagccaatggagaacagaggaaggagcatagctctgctcagggaagggtatgtctgataatgtagagaggcttctggagaggttggatcttaagttgggttttgaagaatgggttaactaagatgatatattaattagaggaaatagcatgtacacgaaggtgtggtggacggttcagggtgtatggcatggggatggtaggacctgagcttacgtttcatgttaagcaagttggatttcatcttccatgtaatgaagaaacactgaaggcactttaaaaggagagataccaaagtgtgttttataaatggatggcttagaggggaatgagttcagatccagggagcccagagagaaaccactggtgagaaggcagatgggaatccagccatcctacactcacatcaaacctgagcattttggggcatccactgactaacagctgccttgcagggtgggctttcagctgtagatattccctttcccgtgattgtcctgtggggtatcatcccttcttccctttgctcttctttccttattctgctgctggtttgggtctggctcttggttgaagagctgatggtggtggggaggaggggacagaggataaacatgcccgtcgccatcctctgtgctggtgtgtcatatggaggagcccagccatttcatcttgcctgattcctgtcttaggacctttctgattttcacacaagaagccttgaagaagggtgattgaaagctaaaagagtttagaagggagcttctttttcctgtctgtaacggtaaaacctctgagaaaatgttggaaggacaaagtatttggtttctgacagaggaaggagactactgtattctacaatggaactctggtcagaagcagcacacggtctttgtggaagcacgtgaaatggtccattaaaaatattaaggagcatgtgagtgtgagtgtaggctaagtcagggaatgtcctgaggagtcatgaatgaagtcctcctttcagcacttcataccctcccccacagcactttctcccttcatctttcaccttccctggtctctgagccttttctcaccccagagtctccattctcctatcaattattttcttgccctttgttgctgagcctgctccagcctttcagaagtcaatcaacaatctgaagacagagtttaggagacttagccctagcatggagaagatggaaagggagagtttgatcctaatagtttgagggacagtttatctgtggtctccccagtcaaaaatcccgtgcatttgctcatgagacagaatcatgacctctgggtctgtaggagtattaatactctattctctgggccctaggaactttatatttgacttaactgaaactggttggatttatttaggaaattatttaattccctaaactaacttctgaagtggtataagctcattttaaaagacactgaagtgagaggttagttaactttctaagcttacacacaaagtgtgcatctgggattttgtattcagttttgcctgattctgcatgtgtgttggtggaccagctgattgtacctgaccaccatgtagaataatgtttctaggggaaattaaaaaacagagttacaaatgagcttttttaaattgaaaattttattgaggtaattgtagattcaaatgcgtatttgagaaattatacagagaggttactggtgcagaaaagctccactttgccagattttcccaaggttaacattttacaaagaggtagtataatgtcataaccagcatattggcactgatacaattcaccaaactttattcacatttcctgttttacttgtactaatttctctctctctcttctctgtctgtattaagttctatacgattttatcacctatgttgatccatgtatccacagataagatactgaatagagccaaccacaggggtccctcgtgttacccttgttaacaacaaatacctccatctttaacccctggcaaacatgaatctgtcctaaatctgtccttcatttctaaaattttgtcactccatataaattgtataatgtagtttgtaaccttttgggatgagcttttctcactcagcataaccccctggaaattcattcaatttggtgtgtgtatcaatagtttgttcatttttcttgctaagcagtatttcatggtatggatgtaccatagtttaaccactctcctgttgaaagacatgtggattaattctggacttttctactatacttaaagctgctgtaaacattcatgtacaggtttttgggtgaacgtaagtttttatttctctgggataagtgcccaagagtacaaatgaacttttaatacagttcataaatccagaattagatttggcgtgatcttgctctgggttgcattttcaccttttatccagttctctcagtctgattttgtgtggggctctcacctatttccctctggccctgggcctgtgtaaatttccaggctgattagggtgctcctgagctctgggaaggagatttgcttcgctttgttgctggctgatctccgggagtcatcactgctatcagtcatgcttgtcagttttgccgcaccgatgtccctttcccccagtatggatgtccagagctccagcggtctgcatagttaagtcagcaactgtgttctgtcttacttcctgtgggaatgaaaggccttcttagagcccctgcgaagtttttttttttttttttttttcccagcccctgtgaaattttaaaaggaatggttgcagctttttcttgccctttggttccctgtagtgaacacatgttgccaaaagatggcagtgcactttgcagccactgagatcgctcttccctgtcgcctggggcttagagaattgtgtcttgttctttatgtgtatgttgaaaatgtgcagagcagattttacaaaacaacaaaagcaccaataaaatgctgtgaagtttagaatcatgaaaaaaaaatcacgtttgcaaatggtttataatggaaatagtcccccacttcttaaacatgatttgaatagggaatagaactcagaaatgtgtgtatgagtgtataattttaggtgtcagtactgattgttatattctgtatagctcctgaaaaagacctgtgaaatgctgatttttgtctttcatctgatccaagattagccaagtaacaggcctgcttttgaactctgagactgcagtcctcaagtaaaggcccttgtatacacttagttttcatggcaaaaatggctaataataaaactcttcacttgctagcattggtcactcccctgtgtgcgtcactttggtgtgcgtctgtgggcatgtgtgtaaagaactgtttaaacattggctatgcaccagaaagctgtgtgaagtgagagattatggggttcaccggatgtcataaacagaccaagctggtgaggataaagtgggatgagttgaaatacaagattagctaataaactttaagctgcatgcacggagagaaccagtgatattaaactctggtatgggcatgttaaacactggtgccctgctgctctctagggtgccatccccgatgccttttgggatggaatcaaaaagccctgctatgaacttgatccatgtgcagcatcgttaagtgcagagcaggctgtggaagagagtgggctagctctgggattgggtatacaagctccggagtggatcctctacacaccagccagtgtgtcaaggttggaggctctgtttcacttcccctgagctcagtaccgcagtcgctttcatcctacagtttacaaagtagctgcaatcctgggtggcagggaaacaggtggcttcacggtaaagcagcaggctttttgctactgcatcctttggcaaaagcttgggctaggaggagaaatgtgctgtgtaaagttttaaccctgaaagcagatgctgttactatagagacaagtgaaatgctacagtgggaggcgtaacaggggagggatgggagaagggaggtgggagggcaagtaaggcgaatctaaaggctagcacactccaagaccttcaacctttagcagcactgtgacggggcaggcttgcattctgaaacttgtgtgctggcggcctgccacgtgctgactggctgagtggcagctgcttgcgctgtgcggactagctggtgagcacgttggcagttggcatgggctctgggggtgggaacttagaggggtggaatgtagatgggtgctcaagacccaatggctgacagttttgcacaaatgtttctcatgctgggcttaagtcacccttacgagcctgctcagtgattaggaccggctggtgaaagccggtccttttggcagtagatatgacatgtgttacagttaaatcattgtggtgtcccagaataacagagaataagaaaaaccttgctttgggtgtggacttctgtagaaagggtataacttgtacggtcagaggcctggctgaaggaaggcattattggccctgagtggattttatactgactggtgtgacccttatccccgtgatgctggtgagaagcttccaaatctattctgaactttgcctcatgctggtgatgtgagcaacccagggagctttttagaaacatgttcttccctttctttgttttcagcgaatgcaggttgtgtgaaaggaacttttaagaatgggtttgagggcctgattaaggactggatgagttaatttcttcctattgatagaaggaggaactagttgggtcagatggttattttaaaagatatctctgtcttactaataatagcaagcaactgctgagaggatttgcggtggggagggacacgaacccaaataattgacatttgtggtgtaaagatgaagaaaaggtgctgaattcctgtattttgtgcagaagcctaggtgcaccaggctggacttacttctaaggaggagtgagggctgctctggagaaaggctgctgtgggtgtacaggttttatattttccatttgcctcactcacctctttttgcttcctacagggaagaggctgctttgagatgctctgcattgtctgtcagaaagaacgaagtttctaattacttgctatgtatagtcttggagggaatgtgaaatatgcatcaaagagccaaggaatgcaccaatcattattctctctctctaattcagatggaacatagtgacagtgcctcagttaggctggatggttttctcagcctaggaagagggtttttctgaacttttctactatcccctccagtttttgctggtttttattttctctttgtttctgtttttcttttttcttttagagatgagaattcactgtgttacccagactggaatgcagtggcctaatcatagctcactgaagtcttgaacttctgggatcaagcagtcctcctatctcagcctcccacgtagctgggacaacaggtgcacaccactgcacatagctaatttggaaaaaaaaatttcagagatgggtcttgctatgttgcccaggctggtctggaactcctggcctcaagcaatcctcccactcggcctcccaaagcattgagattacaggctgagccactgtgtcagcttttcttcttttacttctttggttgttacatgcaattttgggaatggcttaggcacaaggctaaacattttagttaggaaatttgaaaaaaaggcaacaaaagactttaggaccagttcgattaatagtggggtgcagaaatgatgttccacatgaaattgtgttggactctataggttggaaagggttagttctgataggactggaaagggttaatgtgagctaaaccactcttttttctaaaggggagctggcactattaatgtacgtgcagtagcacagggcttcaggattttgttgtgcttctgaggtcttttaagaaaatttcctcattaaactgtcatccttatctatgtctacaaatgtgtaatggatgggttcttgtcttttgaacttatttgcctggattgctaagggtaatctttgagaaggtggatgtgattgcattaggcaccttgtctgtcttgctcactgtaactctagtgccttggcttgtgcctgcaacatagtagtagcatccagtaaatatttactgaatgaatgaatgcaggaaagagaaaagagaactactgaatgcctcctctgtgtctgctactgtgtgtggtatgtaaaaattatatttggcaattagaagacattggtgatcatgaccaaagtgctttttacatctctttccatctttctcagccactcggtagcagtactctccttttgtcacttccttgacatcactcttgcctggattcttacctcattgactgtttttgttcctctgctctgcttgtaaatgttggcatgcctcagcacttggtcttaggtccactccttgatttttacattttcttcctggatgatctcatccagtaatagcttcaggtaccagctttattcattggtttcctaatttttatctctaatcctgagcctctgagctccagactcagacatctacttgtatgtccgatggctcatttttcatgtgtaataagcatcttattcttaaagtggctaaatagaactcttgatttgttccccaacaacttgtttctcccatagccttcccctggctccttcaatattttcttaatttctcttgtccccttactgtccatttttcacatagcagccagggtaatcttttaaaaatgaaaaacagttcaagtcactctccattttagaactcttcattggctcccgtaacacctaaaattctgactccttaccctggttttgtggcccaatcaatatcatctcctaaagttgaccttctagccctgtccagctgtactaactttgtttctgttcctgcaacatcctaaacttgtcttcaccttagagcctttgtacttgctgttccctttgcttggaacacattacctgcaaatattcacagtactgattccttcctgtcatttttgtctctgctcagttgtcatccagaagcctcatgtgaaccaccctgtgccaagcagtccctgcctcattttattttccacaaagtgcttaatgctatctgagattaccttgttcatctattcagtattaattcttgcgaactttgtttctctgattcacagatatatttccctctctctgaagagtatgaggaacatagcaggcactaaataaatatttgctgaaccagtgaatatactttatcatttaatcctcatgggaaccaggggcttagagaagttggtaaatgacttgacttcttaagtcttttcttttttttgagacggagtctcactctttcgcccaggctggagtgcagtggcgctatctcggctcactgcaacctctgcttcctgggttcaagttatcctcctgcctcagcctcccgaggagctgggattacaggcgtgtgccaccgtgcctgctaatttttgtatttttagtggagacggggtttcactgtgttagtcaggcttgtctccaactcctgacctcaagtgatctgcctgccttggcctgccgagggattacaggtgccgggattacaggtgtgagccaccacggccggcctcaaatcttcaaggaattttcttttccaccagaatcttgatggccaacccatatcctgcttgcattcagttttctatttttagtttgagtatagagaaggaaaatgatgtatatcaggatgggctattatatacaaggccgatattattgaaagaagaaatcttgcaagtgtccagaggtaatgagtttcttaatgctattgtccaccattgactggtcagggtgaaaaggaaggaagcagaaaggaaggaaatttacagtaattaaacatgtagtatgtgctgagtcctgcactgtgtgcttttaggtatgttacctaatttgaatctcaaagccatcaatgcatggttgatattattgtgttgagtcaatgcaaggttgatattattaccccagttttatagatggaaaaactgagacttaaaaaagctaaaaactttgctccaggtagcacacttgttcagtggtagagctagatttcttaaaccgggggctacctgacaccaaatttctcactttttatgttatgatggttgctttgtgagatggatatgcttctaaaatagtaaggacaaaaatatgaattcaatgcacatccgcatagattataacaaatatctgaagcacaagaataagttatacagacaatatggaaaacagacctacaatattcaatgcctgagcatataattggatgaatagaatacagaatgaacatttggttctctggcagggctcatgtacggtatgacatagagcagctgtccccagagaaagttctttgtttctagactggtactacacaagcagcatttgagcaattcaggatttctttctgctttcactataaatagacctcatggaattctgtatatcaaagttaatgcaatgaaaaggagctgcagaatatggaaataaaccttaactcattctataaactagaagcgtgtttggcatcgggaggccctaaaaacgctgtcattccttggatggattctgaggtcttatttagcatatgaaattgcagagtagatcctattatgtaaggagacaggaggacagcataatgtggttacaaaatgaagaactttgtgcccttcagggaagagttaacagggcagatatacatagagaaagatgtgtgataagaatgtggaaaatgaatgaatgggtggcatgtatctgtgtgtattgtcgaagccgggttgctggataatcctcagatgtcagatttccgtaaggccagcatgtgactcaaagcttgccactcaacagagaatactgggctgtgctgatattaagaggctggctggaagctaggctcccactgtgcactagcctacctccctgtcgctctctgcgtgtgggtgggtgtgcatgtgtgtgtgtgtgagggtatacattttatgcagtgggtgtttaaagagctaagcactgaagctggatttccacaaacgatcatcacgagcactccagacacaccaaacttcctctcttggtattttttttttttttttgctttcatcctttttaaaaagaattttaaaaccctaaaggggagagcccccaacatcctgcctacaggattgggattattttctcttacctgtctatgtgggtgccctctcaaggttagaactgaagctatgtgggaccggcatattctcgagcaccagatgagaggagctgcgtgaagcagtagcagacaccagaagaagagtgactctgccctgctaacatgaacaacagcttgcaggttaacctgcccagaagctgggctgctccaagtggctcgctccaggagaagtctgagcattctttttttcttttttattactataggatggaggatgaagctgtcctggacagaggggcttccttcctcaagcatgtgtgtgatgaagaagaagtagaaggtgagctttatgggtctgggaaagtgtctgttgacatacatatgtctctatagataataacattcatgcatttcatatatcttacatttttaaaatgaaacaccaaaccttttctatagagtttcatcaatctctacatttgcttcaacacagaaagtaattttaagaacttcactggaccatcaaaatctgattcaatatgggtcttgcctggtttaaaaaaagtcttattttaaagtaagtgcctatgttagctgtgcctcttcatcaaaaataaacattttaccagataatactaaccaccttccaatgactaattcaagaaagctgctcgatttatataaatatattcagcagcatctttaatattctttcttgtagcttgtagtgtaaagatatagatactacagaaggataatgataccattgttgcaggagaaatgggtttaagctgaagatgttaagagtgataatcatggatgactgtcagttaggaaaagatggacaagcattttttatttaaaaaacttcagtctcttttgctgatgtttcctagtgcctgttaaaaactaaagaagagttatgttttacctggtgctataatactttcagcgggcattcccttttcctgtctcctgacttatcaataatgtgggaataatgctatttatttgatagaaggcaaagctgaattaatatttattaaaataattatatgaaggcatcacagatatatgttattattcatatttataatgagatttttaaaaatcagggttataggcaatactcaaagttaaatgaaacttgcaggtgaatcatgtgatcaattccaccatttaaagtcacctgagagacaattcatttgtgttttggagattctgacctgaccggtgccatgtggtaagcatttagtgccagccccaaacttgaaccagaaggtggtgggcttgggaaaaagagagtcagtattgtatgttctggagtgattcttcaagcagactgagcaccaggtactgggcaagtgatgctcctgtgccacttggaacagtttgaatagtgtggctatcatgttgtttctcatgtttctttagtaagtttcttcatcccatgtggtgttagaggattggcgcctccacccgcccccctcaacttcccgcatttatgctcttgagactgactaataagaatttgatgcctaagtttcttaggaaaacggaaactacagtattttctttcatattgttttatgggttccttgcatttttgcaacatgctgtgggaaaatgtcaagctggtgaaagcaaaatagtaaaacttttgtcttaagattcttggaacccatgatgttaaatcatcattttagtgactctgtcactgtcccagtgtcaaagaggagataccagcaaagaggagatacaagcaaagaggagttatagcatatgaatataagaaataatgtagctttgagcaaatagcctatagttttaagacaattgaagtagaaaaagcttgggagtgacatatactgtgtgcgtgtgttttcctttgagaataatgttctagctaggttcacaagagatgtaaatcacttcttgagtttgtaaggtctgtaggattgacagtactctactgaaataggatattgtatactgtttcttaaggctttgactaaaaagtgcgtttcctgaactatttcccttgattttcaagcacaaaattaagacgacaatataaatgaatagcacacaaatctgtagccaggattctttaagaagaaacagaaacacaaccaaaggtggtagaaacatctgtaaaattcaagaaatgtgttggttttgtgatgattaaaccgtccaaatggatttgtgtgttttcctgtttttatgagacctctattttagtgactgtctttcatgttgattggcacctgagctgactacatttcttccaagacatgctcagatagttgccggttgctgagtcctgagccccataagaagattgcttatggattattttgtgggtaactttcaacagtgctgactgtcttacagtactagccttgaaattatagtaattgctcatttgaaatgaacaaaattgttcatttttaatttggtgttctcccaattgaccctccccctttttcaccttgctttattggtgggggtgggaggtcttagatttttatagtagctctaggtgatagtataaaacggttgaaatggacaggggttttttggcacatccatggttccagtgattgagaatgaagaaacagacggcctatgttaagacctctaagaagtattcacattttgaggggaatgttttttcccaaggatatgagtccatctcatatttttaattgcatagagaagagtgtatctgaagaaaagcaaactgttatctctattctaaagtagcttcctggcacatttatggcagaagtgaatgcctcagttttaagggtcagaattcaaaaggcaaggagctggaacactttatattattatttacattttcttttatgaaagtagttatttctgttgcttctaggataaacatagaagtttacaatgtttgtaaacattcttggcaaagtcaacttaaaataaaactttgttttttacagttatctgcataaataagatgtactcccaataagtgattattaaagtaactaaggtctgatagttcttgttactttgaaatatttgtgctttaaaagtgcttagggtcccctaatttggggtgattggagtcagctcaacctgaaggcaagaagagccagatactctctcttagttgcttcgaatgctgtggttctgaggagagagacttcaaaccacgccctcagttcaccttgttcaactttactctcagtgggtggcatgacacttaatccacattctaaaaacttaatagaaaaccatcaactgcaaaactcactaagcacagagtgagtcacaagaggagtcatctgtttaagtaatgaatttatctatgtggcatatatttaaaggcctaaacctcattgtcacataattttcttcatgtgttaatggcttaaagagatactctttcaaaatgaaaccaagtgccaattttaatctttaaaataaatagaagcctttaaatctgctcttccactggttaccttgtactatgcgtggttttaaagttaacatttttaggaggagaggggttactgtggataaactcattttaaaatgtcagtatttcagatattcatatttatttctttatcaaaatgccccagctcccacccaggcccttccacgcttccacagaattggtctgtagatgacaaattaacattaccagaatgatccataagtgttgaccacgaggaacaaccactcacttttcgtttcaaacatagatgggggaaattgctaattacgtagcaattacgtagtgattgctaattacgtagtgaatgaagattgagataggaagagtcagtcccaggtaactttttccaaaaacagaagaaaatcctatggatgttttattcctaaaaaagccagccagaattttggatctgtatgatataaacagattacttaatagtctcatattttgcaataggggaaaagagcaaactccaccttatcctttgagataaggctttggctctgcaaggctaggtaactcccagcaggccttggcaactctgacttcatgaggaggggcctcttcttaacatcaagttcaaccaacaactcagaaaatataagatgcagtaacacagtattggttgaaatgtgtctccatttttgaggcttggtcagtactctcctagagctattatgctatattgtgctggttttcctcttccattcaaaacttaatgcagtgggaagtatgcacccatctgtcccaatggaagaataattctacaaattcacatgtctactgatggacattaggagggagtgttgttgaaaatgcatggaatttacaggaggattgttttcaggaaaagtaaaaaaagtatgtcagggtctgggacagggtagatattcactaattatttgttaagagaaagaatgaataaatgaatgtataacataaactaaataaagcatatgtagaatcactttgtataatactctgacatattttttaaatttttttgttagaaatttggttctcaaagcctgacgtggtggtcatgcctataatcctagcactttgggaggccaaggtgggaggatcacttgagggcaggaattcaagaacatcccagaaaacatggcaaaaccccatgtctacagagaaataaaaaaaaaaatagctgggtgttgtgcatgcctgtagtcccagctactcaggaggttgaggtgggagaatcgtttgagcccaggagatcaaggctacagtgaactgtgattgtgtcactgcactccagcctgggtgacagagtgataccctgcctcaaaaaaagaaaagagaaaaggaaaagaaaaaagaagttttgttatcttagtactcttattctaatgaaatgatatagcctctcatcttatccttggtattactcctgcttgattttgcagagatcattatcatacttatatcatttatatatttatactgataagaaaaagaaggtcctaaacacctctgctttatcaaactttttcattctcctactctgttttttgaagagagagactaaaataatgaaatggtggcttttgtctttttggaagtcaagacctcaacattttacagacatgaaatcatgacttaaacctatttcttgctagaggatatgatgatcatctactcgtgtactggagaaggtagtatttttttctaaaaaaactggggcctggtagacattttttaattattacaatggtataaaacgtaatttctgagaaggagtgaatgaaaacctatcggatgggcagggaggggccaagttgggactggggctattctgagcgctggatataagtgtccggttgcattttgctgacctcttctctgctgttcactctaattgctcagaaaaacagtgtgtacagaggaaactcttgggcaaatactgctaaaggaaaagccttcttaaaaggaaacaatgtatccacacattggcccactttaaagaaatacagtgaggtttttaaaagttggtacttgaatagtaacataggtttcccagaacaggttgagcccatacagacctttcccagcttcctgctcctttctcctcatggcctcagctgaacgctggccagaggtcctcaagtatgcagcacttagctctgtagctgcctgacatctcttgctgtgtcagggaagttaaatatttatatatagatttctttcacttcaaggaaggctgatgatagttccgtgtgtttttgaaactagaatcagacatttcttctgagaatttgagaattttccaactgcagagaattccctggtagtatagtatcggccaaagccctcttgaagccatttcctatcctaggtgttggtgttctttgatggcaataagccataccaaattgcacgtggtacttgcattgtgtttggcaaggatccagaaattctgaaatagtacacttatagcagttttgcctatagattgagcttctttttagaagctttttatctggtcatattagtgagacatgttgtttgatatttattttggggagtctctattgtttattttattcaagtgttgtcaaagcagaggcactaagtatcagtttgagaataaaaatttaaaacttgctctattgccaaatcattgcataggtgaaggaagcaacttatagtttagattatgggtttttctctttgtaaaatgggagcaatggagcatgtcattcaccttagaactcttaagaacttccaacagcaattgctgctgtacctggcattaggaacaggagtgctttatactccaccactgtctgttgtttttctttctgatggatacagcctcaccaataattttctttggttattataatcttctttggttattataattttcttttaattacttaattaattattttcttataatttagttattataattttcttataattttatataattttctttggttattataatcttttctacaaatcgtaactggtgtaaatattgtttacttgcttaattcatttctccctacatctagcctttgccttcctaaccatacttacctactgcttcttatattggaaaactaaagccagaatgatccattgaaacttcccaaggcttactctctgtttgcctttggactcattctcatcctttaagctctgggtatgaaatctaattttcacagttagactgctctgatacacattatccttaatttgttaaattgtctttttttccaagaagagggatattaaccataattgtatactgggtaaaacgcaaatcttgtccattgtataataaagcctgcaatgttgcttcatttggaaaatggattcaagaatgtagtgtttttctgcgagtgagaaggattcaagagtctagtatgtgtatatgtatttaaacatgcatatagaaatgcatttccccttgtctgccacatagactagaatacttctgcttcctactggccattatgtaatttaggtgccaattaaatgagattatgcaacagtatggaaatactactatatattctaacctgaactaaatatttccccttttttatcaccatgagattagaaatcattgggagaactgagaattgggcctgatgagaatgagtaaaataagaatataataaagatcagttgaggctttcttgttgctgtcatgagcttgctggtgagattttattttattttgttttattttattttactcttttggctgattgcatttaggtgactgaggtgagagcctgcaatggcataggttcacgggaggttccaacattcatccctggatctgctgattgccaggtgggatgaaaggtgaaggtagtgagggtggtgagtgacatccactgaatcagcagtatagatgacttaaataattcatttctctgaatagctgaaaagttttcaaatctggtaaattgtttctgcctttccatagagttagaattagaaggcagctatccaaagggctatatccaatgtgtgtacctttcttcatattctgttgatttttggaagaacagactctacttagacctcatgaaatattattttagtgactattttcatggtggaatgctcagtaacttttaccaggccaaaaacttccgggaataaaaagaggttttaaattttagtaacattggccagtatatcagctttagaggaatggaattacattgttatagatgggttaaatcactacccaacccccaattgattattaaattttcaacaggaaatttgattcctactgaaaaataaagaaaatgtcttcaaggtagaatgaaagcccatgattgaatctaatggatacgtgtgtttgacaaattaaattagtatctgattattcaagtttttactcgcttttattccttctgttctatggtttagagaacatggtggtggaccagtagtctcaggacctttttctgttcctggtctgccactgcctttctgcataatacaaggcaaatcattgtcatgtggttatggttccttcatgcaaagtgcagtgagtaacccatcttcttagccacctactagaaatgctctaagaatttttggataatacctgaaaaataccttgatacttccagtaagccattaagaagttacttaatttctgaatctcagttttttgtacaagatagaatttgcacctctcatctcctacttttttctaggaatataagtaaagcaatttgaaatcccccaggattaaccgcataaatttaaggtattatctcccttgcaggtaattgttgtatgtaatttatctttatgtgcaacactttctcaccagtggttgctgtgactgcagaacactttcacactaaagctaatactaatatctggtaatcaacagattagttgattagtacttacgttaactcttcttactaaatttaagtaactgatggaccatgctttttttttttttctttaagccgatcaaaatggtaagaacagttgcaggtgtgacctctaatatgttgcttttccaggcttatgtgtatcattgaatgtgataacattgtaactaggaccatgattattgtttagtcaaataaaccagccattatttaaggacacaaggttagttgacatggtaattttagagatgtatcacatacgtaggtgagtttacatggaaggccagggaatatatctcctacagaataacattaaattgagacctaaaagaggaaaaggaatttgctaggtgaagaatcagggaagcattccaggcaggcatgtgtgaaggtccagaggtgagaaagaggtaggcccatttgagaaacagaaataaggctacagtagctggaccatgtgaacagggggagagttctgaggtggataggacccagataactcaaggtcttttatgttatgctaaatattagcattttattgagtgtgcactaaggaaacattgcagaagggttttaagcaaggaagtgataagaccaaatttgtattttagaaaagattcctttggctgctggatggagacagtgtcccaagagggcaaagacagaagtgtgggggctgttgccaagattcaactgagagatgattttgggttggacaagagtggggacaaaaaagatggagacaaatgtgttgaattgatgggtggatgtatggatggggatggctgcttctggatttctgttatgagcaatttaggggatcatgtaccattttgtaagatggggaacagtggaggaagagtggtgggggatgataggagtttagccttttgtatatattgaatttgaagcacctgtgagataccgcagtagaactctgaagccggtagttgactatacaagcaggaactaagaagaaaggacagggatggagatataaatctgggagtcctaggcatatagctagcatttaaagccataggaatggatgatattgcccagggtcaaagaatggagtgagaagaggactcgattggactctgcaagtgccaacatttggagattaacaaagtgcagtcatagaagtaggaggaaaactgggaagagggtgaagcctctgaggccgagaagagggcttttaataaggagctagcaattgacagtgctgaatgctgccttgaagtctggtaagatgaggattaaatagtagctactggatttggcaaaaagaaggtgattggtaacttttgttaacaatgtgggtgtcatggttagttgggaataagagtgcccaagagaaaactatcattatgagaagttaggaagagactttgaggtgatgctggaaaacgtttagcctttccctctatgtgctccacttcacttaactaattaaaacatttggaattattatagatgttttagaactagaaaggatcttagagaaaatttagttcaataggctagaggaaccatgaagaagttaaatgatttcctcgaggtaaccttggtaggagttggaataactaggacaaggatccacgtgttctgactttcccaaggctgtgctcatcccaaaagagtgtgcttgaggttgactccctctgcagaggaaaaggaatttaggtagggagatggatgagaactaggagaagcacctggaagaacaggaagtggaaagacctgaaaggaataaaaggtgttgaaagagcttacagagaggtgagagggaaagaagacataagactggctgcagcatttgaatgacccctggtagtaagtgggaagacagatgtcccagctagaacattgtcatattttggagcagtttatggaactaagggtggtggatttcaatttgtcattctgtatctctaagacaaacatttccagagaatcctgagcccatttttcccttctcaataattactaacttgaaaggattaatcgttattattcttttggctgttttttccagacagtggaggatgggagggatgggtggaggactggtaccatgatagtggaaaaatgggaaaggaaggcttatatatccaggggcactaggagtcctagtctctatacgtcattaattgcctatttgactttagttagatcactggtaaatgaagaggctgaaccggttaaagtgatttttaggccactttaaaagtgtgattatgtgctgctgtgtcaatgaatgtcgtccctctttttcctgggtgcatgtggaaaaccacagtattgaagattctgggattctaggttaacagaagtctctcatagcatttttcctagttctgggtaattgttatagccctatggtattatctacatctcatttacctacatatgtgtatatgaaggaagggaataatgtgaactttaatatttatattttataacaaatataaattaatatttaatatattaaatatttacatcaatattttatataagatataatatttaaaaatatgttcatctactaatacaatataagatatataaccatatgtaatattttgcatatatgatatataattatgataatagattaacatatattaaaatatataatatttatatattatattaaatagttgatacctgattagccatgagtgtattgactatattgcagattacctgtctatagcaaccaaggacccttcatcctattgcccagccagggcttaggccactgcaaaaagagaagccataatagagtcagagatggacaatgtggttggaatgagagtgtgaacgtgtgcatttatgtgtctctctaagctgcctctctggctgcaattgcaaatccagttatcaatgaccactgaattagctattgtttttttatcttccaaccctacttcccattcagttgtgcaaatggtgaccaaagagaaatgttggaaactgtcagttctctgtgtttggctcacaggtggattttgtctgacagcatgtgtactgcatattacaatgcagtagcccgtgtggggtggttctgggtgtcgggataagtggagggttcatgtcttcccgttgggtggcttctgctcactctgagcactgttctgcctagtgctggacttcctaggccttttggctctattctgtctcgttggagcaagtacaaggacttacagacctgtttcctgcagattggcagtgagccattgaaagctctgggggaaactttgcccaaatcagggtggagattgccaagcccttgcttctggacagagttagggaagattgaggttatggaaggtgctgcctttgttgaagagctcaactctgtaggatggctaaaactgccgattaagggacaagttaagaataggtctgaggttgactcttttgccctcctctaggtgaatgttctggagaacaaagagtgttcacaagttagttattatcagggctggaggtgggtgggaatgagaaaaaactgtgctctgtttttttctcctttgaaaagggaagggagaaataggatcaacatttatgcagcacctttgtgtaccagacacagtgggagactatgtttaattcagaatgtgcattaaataaatatatatttatatataatctctctataaagattatatagagatagatatatagatatttgtataggtaaatttatatctatatagatataattatatagatatagatacattttgtatctatagatatgaaagattttgctagagcaaagttaacattattttggagaatcaactttgaagattgaaaagctcttcaggaactgcagtttacatagggtaacctgatttctaattttgttaattccttaaggtagattcctgaagtaactttaaggggaaattcttgtttttctagctaagatcttttcaaataattgatgatcactgaacataataaagttgtatttctataaacatattcactaattcagactttatagagtgccagtcagtttttgcctttactatcagccattaataatggaaacttcaaaggaagcttaacttcagtatgtggtcttaggcgcctcaccttcatctaagactataattaatagaactgttttattaaaaatgagctcttggaagacagatgcatacgtttgctgagctaaaggacaggagtctagctaacaatcataagcttgtgtctcctttgagaccttttattctgtagctcttagttcttgcctagagattgttatcactattattatcatcatcaaatattaaatattaatagtgctgtgctcagtgaacatcaagtaacaagctaagatttcttatcagtcttgcttggggaacctcaggttgccttgaggatttctgggaggctttcagtatataaaattcccatgcagttcagtgggaagaaaagtatttccctgtttttcatcacatttgtcatttgcttgcatgcctggtcctgtgtaataggtagcgttaaaattaaaataaattacttatcagtattcaaaattatctatacataaatgacatatgtaatacgtaattatctattaataaacacattattttttatgtaaaaaaattgcccttatccatatataaaaatagaaatcatcccttgttctgagtctggaccctcatgcaaaatttcataaagggctggtttaccccctggtaactgcaaaattatgctgtgctttttgaagggggttttcttctcatgagctggtatttataccagtaaattagcaatgttactttgcttgtatcttattagagctgcttatggacactcttatgggtttgagaataataagctaacaaattacttgtattttggctgagcgtggtggcttgtgcctgtaatcctagcactttgggaggccgaagtgagtggatcacttgaggtcaggagttcaaaaccagcctggccaacatggtgaaaccccacctctaccaaaaatacaaaaaaactagttgggcatgatggcacatgcctgtgatactcaggaggctgaggcaggagaatcacttgaactggggaggcagaggctgcagtgagccgagatcgtgctactgcactccagcctgggcaacagagcgagactctgtctcaaaaaaaaaaaaaatcacttgtatattattaaagtgtttaggattatacatacttgtccatttcttgttaaataaaagtgtcaaccacacagtgtccactgtgcctggacttgatactgtagtttggtttaagttttcttatgcatatacttttaactgagatttttttttggtccaacaagtaaagtctttgcagcatctttttataatctgtcactcatccagggtctccgcctcttctacatttttcttttcttaataaaaaaaaataaatctcttaattttgttctacctacattcctcttggcaatagctacaacatgtcttgggcatcttggcagaagaccaggttatattagataagccagggaaggcagtatttaactcatattttgggaatattgctgattagttctgaaagaagtatataaaatgctgcatgttgtagaatctttgctttgaactggagagaacagaaattcagctgaaagagtaagagtgtggctataaatcaaatctggaacatccctcagtgtttaattagagatgtatgtaagaggctggaggtaggggatggatggtgggaggtggggaaaggtagacttctgggtaaagattttacctgtcctttggtgatcctttagatagaatacagtactgacatatcaggttaaaaaattatatactaccttattccaaaaagctttagggtgaagggaaagtaactgttgaaaagttggaagaatgaggttgtgtataaaatgcacgtcatgaaactctatatgctcactacgggtttgcctaaaatttgtctattctcttgttagcagccaatgaggaaggtgacataataagttattaaatttatgatataaatatagtatgttttacagaacacaccatcaaagtagtgatgaagcactgtactagtcttgatactgagaacagagacatatttctcctgtggggttttatgaagagaacacttcatacaaagttaaatggttataatgtccttggcttcctcaaactgtggtttttgcacctgtacaatggggataggagcaggattgcatgaggaggtagatataaaacacctcgcagtgcttggcatgcttgtaagtattcactaaatagttgctatcatctgtatgtacagtaaacacagcaacatgtttcccaggaaggagctaatagatgtatcttacatatagaggcatatgttgttaaccatccactcagctatagaatttgtagtttggctgatctaaaacccttttctggcttgaaggttttcatacttcaaagtgttaaatcatccttggtagcaaaatgtgtatttgtgaaagccaccttaatttgaatggctccagagttactaagtgtaagttttttgtttgccagaaaacattgtagcaactatgagaagtatgaagttaggttagaaatatttcaggaattgggataattggatgagttaacatcatagtacttcctacttgcaactggggtggagcatgtaaggatgggaagaaacaagaatcacgtagtgatcatttctgacattcagagatacccaggaaagccatgttttctttccagtagtactggctgtggtacggattgggagatattcccaagatatttagagtttgttgggaacttgcaccatctgtcagagaaaggcatgcagggtatttatttgaacacatgatactgaagccactgccaaatcaaggactgaatgctctttgacagcacacctaaatgaacactgtcaaatgtagattccagtagttttacttcatgaagtttcagtagcaagaatgtaacatttattttgataacatttaaaacgatcacttcttcctcatacattatagctcttaaaattttttccactcctcctttttacattatctttggaagcagtatttcctgagttttctagtggagaatttttttttagcctaaaaagttctgtataagaagcaggttaactatccctgattctttaatggtcttactgttttgtagtcccttgctgggttggaaagcttgtctgtcaagtttctccttttcatattacagggaaaacaatactatatcctcagctttgtgactcccctaagaacttgcagtcattttatgagttataattttaaaaatagtcatcagtcttcatgacatatcccttaaacaggtaaagagattttaatgaaaataaatattgagatccacatgtgatgttctcatcaatcatagcatattttcaacagtaatgatgcttctattgatcatgatgacagatattctgtgggggcagtgagaaagcttccattacagctcattttactttcggtgttttggttacttggcacatatagcttattaagtatttgattgtccctttgagacagcatgtctgtattaccccatccaccaaagcaaggctatcttgctctcttcttataggcaaggaagctgaagtgagagaggctgagaagtaactgatggagcagaaagcactgtccctgagcccctcaaggtttgcttaaccatggaactatgttccttgtcctctacctgaacacaagacagaaaaggaaaatttagttaccaatcacatgtgagaggaggaggatgctttaagttttgaattgctcagctcagtggcttgatttcctctggcagttgttggaaggcaatatcttcctcatccagggaatattgtattttattgtgctgtaaggatgtctacaaaaagttcattgccatatgagtactagagaatggtagcttcgcagaggccatcactaagagttttaaaacgtggtcaagagtggttgcattagacaggagtgggaacagagagtgactgcaaatggatatgagggatctttttggattggtggaaatgttctaaaattggattatgatgatcgttgcacaactctgtaaatatactaaaatcattgactgtatcattaaaatgagtggattttattgtttataaattacaccccagtaaaggtgattttaaaatgcctaaaatttggcatgtcttgagaggaacaacatttctgcttgacctctgggcaccatagcacttcacagtgcagtgtcaattctgaacgctcccacacctgtgtggaagtgcacagggaaaaccaagaaggaggagttggaggaaatggggatagacagaatctgttgctgagaggatgcctatcatcacgatgtgaacaaaatggcaccacttatgtgataatgacaactcaaagtaggttccaaaaagtcaagtgcatttctctccagggtttgatggctcactctctgaactggcctaactctttcattagattgaccatgatgacacttcctagccagtaatcttaccttagcatcttatccacccatatagactgtctattaaatgatttgatcaaatgtactatgcagatttgggtaaatataatttaaaaaacctttctatataacatcatatggcaatatagcttaattaccattttttgcttagccgccatatttaataaggtgaatagaaaatatttaatgtgataggtttaaaaaaatttttcaacctcttaatttgtgtgtgttttcttgaaaacaaccaagcatttcgtgtttgatttattgaagcaattggttggctttgctcacttacattgttaagacttgagataaaacttcaggactccctcagtaactggagcacaggaaacaattgacactgtttcttaattcacattgtttctgagacatttcctacttcctagtataatatagctttcccatgagaaccatttgcttgcaaatggttacacatgatagatacacttctcactggcacacattctgtggggagaatttcactgtgttttgtagtagctgagttgctgcgtgtgtgttgggaaggaggtcctgctttatgtaaagatgcctccaacttcattcaagcatctgatgtcttcttttgaatactaacccattcacttaggttctgcattgcttagctggaatatctttcctgaaggagcatataattctttgaagcctgccaatttaaggaaacacccctgccaattatggtgtttttagatataccccgtaggttactgtggaaagtagttcatgacagtttgtatcatacatactgtatgtacatgtatttgcatgtaggtacgtgatattggctgtggcattgcaaagttgtcatcaaggaataattccggaaatgggaaataaaacccatagatgagaaaatctaatctaatttgcagttcagacaaaaatgttcacattatttctcaaatggtagttcctaaaatacagaagttatgctgtatttaaagtgaaagtagaagtttttcaatttaaaaaatgatgtggaactttgagtttctttcttttttgtcttattagattttgtaaaaataataccacttgtcagttttgcagctccttccatctagagagctgaaagcatttcacaatcttttttcctcatgcccttctcttcaaggcaatttttgctgggctcggtttatttttatcattgcaacaaccagtttttagaaacttttggaaatgaaaaaagaaaaatgagaatggcactgtagctgacattcattttagctgtttcctagtgtgaacgtttgagtatttctaaaatcttttctccaagtatgtcttatttttctcagtttgtcccagttctaagtctctattttgctgattaggtaaaaaaaaaaaaaagttttaatgtaaagccttacccccagcaaaatgactttttgaactttgataaatctttatttttgcagcgccagcagctccttttccagcaggcactaaccctacccagtataatcatagactcatgtaaggctgaaactggagggccctctagggattacccagtttaagtctctccttctagaaatgatgagaggcccagagtggttaagagatacatgcttaaggtcagacaactaattgatggcagagtatgacaaacatgaaggattcctgatttccagtttgatattccttggttttcctaaacaaaagtagtctatctggacagaattagagtacactctcacagagtcctagtgtcagccactagcttgaattatactgaagctaattgaaaattgggaggaaattttatttttctagagtttgccaaatatagaatggtaacgttgaatttatagacattttcttctgatctgtgtatcttgtgcaatttgtctgcagtagagaatgtggtttgaactgactggtgatttgtgtaccttccttaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcagtgagtactctctgagcgttggtgcctctctctgcctcactcccacatctttgagaaggacacctttttgaatcttgtggctaaaggggagggacactgtaatactgagatgtttagaatctgttctaaaggataatgtctgtggagatgctttgcttgtaccagcaggttaatctaggaggtcatctggtaagattctgagttgatcagaaaaggcctgactaagtttaggcatagctgtgtattctacatttttatgtgtaatagggtagtattgcagatggtatttaactacagcaataaacagtaactggaagactcttaaagaattttttgcatggtttatgcttagaaataggttctgttgagacagcaggtgaagatgagagtgtatgtctatatatttacatatcttaccaaatgtcagcattacaggtgacataaaaccaggttatgagtcaggtcagtgatttaaataggaattgtggaaaatcatcctgtaagagagatctgtagagtgacacagttgttaagatgttgaatgtattagatgtcatacactggataaaagtgttactaagagcagaatagcaggaggtcaaagaacacccttgaattcaagtgataggataggctgtgtgtttagatgtatgtttatgttgctttttgtttctttaatgtggagaatatttggctacatgggccaaatattgtggctgaactgagaatgaatatgtgcagtagaaacacatgccaattttggaagattccccaacaggagttacacagtgacagcttttcatgttggcagagctctgtacattcttcatgtctttgctacagttgcagaaatatggaccctgcaataaaatgcattatggatggcacagataaagatcgggttcagtcattgcagttgatgacaggccaaattagaatgaacagctcaagggtgttgaaaagtgaatttacagagttaaattaaagagggtgtgaggcatagtgatgtgaattttttatagtctcaccgttggaactgagcaggtggcttaggaagctagagaagtgcggtgctaagaggagaaatacaggtggaccatcgaattaaagacagaagcttggaggggagcttgagatggatcatgaaatctaaattaaaagcattgaaataaatttaagacttagaaggaccagaaggcaggagactcaagttatgtacttttcactgaagtactgggggaaggtctgtctgaaagggatcctttacatatcgattaaggtagtggagtctgttttgagaaaaggccttaaaatgcacataaacatggcacagttaatagtctggaggaacaaaagataacattcttttccaaataaatgactaccatttatcttgatttactctgtatccatctgtcaaggcctgagccagtgtcaagtgttctgtccattgtgcatgtgattgtctactctctctctttctctcctctctgtgtcttttataacttgtctttcattcttcagattagaacaagagtgcatcatcactattaatgttaaaaagtaaagaggtgctcacctagacaaataggcccaggaattttgagattaaaattatatatcagcttttgagaagggcagtggaaacagtgccagcagcactcagataggtcataaggaatgaacagatcaggaagatgctgagaccgcatgtgtatcaaccatagaatactgttgcattctgtggcatttggggaccagtttgaatacagcatttaaaataaacaaggcaatccattctctttcccctcagaggtttcttcctgggggaatactgcattatgttgtatactggttttctgaagggatcctatggagagacagttgttaaggactaaattgttcagtgatcataaaaaaattatttataagtatgcattttaccgttttgttcctgctgatcaatgttatacactaatatgcctttggcatatttgatatgagttatccaatttgacatgaagattctcttagaaattgctgtatatcctcagctgctttgatggattggtagttaattatttggtacagttctgtttaaaagtcagagtttttgcacctagatatagaaagacatttaaccccatgattttgggggaagccatagggctctggcaccaacatgatgacaaaattgttgtgggaaaactgaatgaaatacttgcctactatactattattgtctctcaagaacagccacataacagtttctgttgttctgtgacctatggtgtttgagttgcttatgtccatagacataccacgtcccatagacaaggttcccacatgtgtctggcagtgcgcgatgtgatgcttatacttctgagaaaaacaaaaaccaaaaagcccacatataaatagtaacttgatgggagtcatctttgattctttccttgctctcaccctcatatgcaatccttcaatgatttctgttggttcaacatttaaaatagatctgaatttttctgttcttttcagttttgcggtcacatttttgtccagggaatcatcacctcttgcatagacactgcagcagtctctgctttttaagtatttcttcatagagaggcaccattgatcatcataaagtgtaaattggatcatgtccttcctctgctgaaaacttcccattgtcctaagaataaaacctcaattgggcatcatggcccagtgtctttctagtcctgtgatgtgccattctctccttgctcactttactccagatacattgatattggagttccttggtgctaaaaccttttctgcctcagggcctttgttcatgcaaacttgtcttcctgaaatggtcagcccattcttgtcctggttagtttttctgttcctgtatgttctggcttttaaattttacctcttcagagagtcctttccttactactctctctagtgcagattccccttcattattctttcccaacgccttatgtttccttcagaatatatgttttaacatgtgatttttgagagcttacaggtttgtcttgagctgttgctggattgtaaactccgtgagagcaaagatcaggttgtcttgttcactttgttatctttggcgccgcacaatgcctggcacatagtgtgtttttcatacgtgtttattgaggagtaactgaatgaatgaattactacagagaaagacgtaagcattgctttaattggtctaaatatttcttatatcctagatagagatccagctgattttcttgtttttaagcctggaacatcgtatttatatttccctgccctgcctttctcccttggcacataaaatctggtcttcgcttttaattatcccactttggaaagtgcctcattattttgtctatcgccaaagtgggattttggtctgggtaggtaactcccaagtgtgtgcagctgcttgttaaccacaggtgagggatgaaactgaaccgcaaggcacattaattttttatatacacttaaaaatgctcactgttccacagagcaggcagccccccttcagaagccatattaaggtgacatgagctggcaccgtggcacatgcctatagtcccaggtgctccagaggctgaggtgggaggatcatcagagcccaggagtttgaagctgtagtgctctatgattgcccctgtgaatagctgctgtgcttcatccgtggcaatatagtgagaccctgtctctacaaaaacatgaaagggcatttataagaagtaaacgaaatatcttccagtatttaggcacattaaggagatggcataattaacaggttcatttagtttataacctaacgctttctattttcttcatggctttggtgtcaagaccgggtttctaaaaaataaatgagtgtttgatttttacacatttggagctctgaggaggaagcgagctagcttcgtatccccctctgagctcagcagcagctccaagtcctttcacagctgctattcccagtgtggcgtcagagctggtgtcccagctggggacacagagaaggaaacgtgtgtgagagcgtggtgcactgagccatggggagagagaagctggggaaggaaagtgaaatggaagaacaagcaggagagacaagggaatgaggaggtggtgtggagtgggtggttgagagaaaagttagattgtgctctttcttaaaaataatccttttgcctcctccactgtgcattttttttttctaagttagcagctgccatcctctgagggttgcccaaaaagtgggtgggaaggtggtcctggctgagataggctttggaaacacagcataccttcccagcctacatggttttggcctctgtgcctcccattttgttagtgtccagggatacttatgggggcatcacaggctactttgtgactgtagagatcctgaagatgtgtaagatggtaggaaacaaagctacaaacagaacatcgtgttcagcattttgatctgatgtgtaagatatttcttgacaagcatgaacatgcattcatgcttggaggtgctaactgcctctcacacacaggtcttgcccgttgtggaatcatagcgctaggtatgtccatacagacactcattcagtcttgtggtattcttttttagctttttggatgtgtaccagaactgatggatttatgctagtgaacattgttctgtgagcctgggacaatggatgctggttggtgatccagttatattcaggaaactgaaacagagaaatgggcagctgcttttgtttggtgcttccgggtaaatgaacagagtagcttttcataagagccaagaatatttggtgttgtgtcatttgacttccccttttcccagtgcacacccctcccaacctgacctcatacttcttggtacatttgtactttttcttgatttttaaaatgttttcaggcaagatccttaattttgataccataaaataaggtttctttaattttctacatgccattggtattctcaaaaatcgatctatatataggagaaaaggctttggaaatgtatgaaaatgaggtagacctgtcccagtttaaaaaacaaaacacaaacacaataaaactataccatctctttcatccccttctctatttttcaccttatataagtaggaggaagtactttgtctttaggtctgagtacaaaagctttttatattaaaaaatgttttaaaacttacagtttgccttttcagaagggacacttgtgttgtaattttgctggaaagggagcatatcagagtggttaagagtgcatatttgagccagattacttgagtttgaatcccagttcataccagcagtgtaaccttggttatttacttaacttctttgtgctctagtttcctcatatgtaaaaaggggatgatcgattttaatcatagtattctgaacatgaagtgagcactgcatgtagtcagcaataatggttagcagttattattttgagttactatgattgccttcttcaagcttatcttttcctatccatcatacacaggtaatgccaaaaacttgaggctaaaactctgtagagcttaattccttgtaaacaataaccactattctttaagctcttctggtcttttctgccacaaattctcactaggcgttcttttgctttagctgtcggcttggctcttggctcctaacggcatatttgagagaagcaacctaaattcagtctcttatcttgccagtgagtgtcagtctgcacgttggctggcaggtgagaggaccaagggaacaaggacttcaaggggcagaggtgctgtctcttgtgctgctcttttttgtggaatactgccaccagcaagtggcttggtgtaccaagggtgtccttgaatttagtcggcagttgtaattccccgttctggatgcctgaaatcaaatagactgttctgtcttttacaggaaggatctctttctggctctttctttgtgtttctttgtgaaattaatctggttaagaagggctgttgggtgggacaagtcagcaatttggaggcagtgttgtgcagaaaggaaaaatatttggcatacttgtgtttttgatggcaatgggttggctcaacaatgttgtgttttgtgtggtacaaataattgttgtttattcctctgtgatgctgatgaatacaagaggactgtgtcatagtgcttctgcttctttagccagttaactgcataagtctcttagagagccttgagtttctgaaatgcagctctcttgaagtcaccttgaagtgcccttcaaatggcagattttacactattcatttcttgttgccactggctattctattctaatagttattccatgttatcatgccatgagatgttatgagtagtgtgtttacacgtgtcatgggagagttgatgttgttgctatttatagtgacttatgagttcaggagacctcaaagggttctagtgtactccacgtgctggggtgctcagggctaaaaagagattgtgacttagggtggaaaatggggggaaaccagaatactgtgcagaatttcagtgtgaaatttactttagtgaagtaaatggggtataaatgactgtctgccacaggcattaccacctaagcggaaggcaggtcacatcctgtggtttgggattcaaatttacaaggcaggaagcttgaatgtgtatttgtgagtttgtgtgagtgtgtgtgatttgaatgcactgaaaaaaagaaaggtattggcaagggtcttcttgaaatagtattctgtttaggaattttttcatatagaaggaaataattcttaaagaacaagggttcttaataccagggatttaaattcagggctttatgagtgtgaactcataaatgcagaagtagttggggtgagggaccacgggcctactctataaataaattctgcggaattcttccatgaccacaatctggaggcaggaatgttaggctcttttaataactttcccatggataggagtcttacttgacttttcatcacttttatagaggtgttgcgagcaaggagtctccattttcctggttaatatagaatcaagatccaagttatcctttatccttctctgttgtttttcttccatagccagccatgcactgagcgctgttggtttttccttcaaagtttctcttatgtctgccacttcctttgaattcctaaggcaatacttcttatttggaatttcagcgttaagttcatccttgaaatagaagggagttatttcagacaaggctgccagacatctaaaatattagttctatagtctctccttaattaaataacaaacaaacaaacaatcctttttttttttctagcaaacagtatttattcccctttccccccgggtgtcatttctttgggaatagaaaaatgaccttgttttgtgtatctagccaacaattcttttttttttgttatactttaagttctagtgtacatgtgaacaacgtgtaggttagttacatatgtatacatttgccatgttggtgtgctgcacccattaactcatcatttaacattagctatatctcctaatgctatccctcccccctccccccactccacaacaggccccggtgtgtgatgttccccttcatgtgtccatgtgttctcgttgttcaattcccacctatgagtgagaacatgcggtgcaaacaaacaatccttctattgctcatcattacttaaagtaatgagtaaagcaacaatgtaacaaagtttcctctgctactttcaatattttatgtagtttaatgaaaattatagatgtactgtgtctcagcaaggccaccttaagttcatttttatgaactcataataacttccccagtttttgaactcttgcagcaagtattatctacatcacacaatctgatacttagatatgtaatgcttcaaatggtgacttacctctgtcattcagatgtatgtcatctcttcagtattatcattagagactcaaaggcagaggcaatattgcatgcttcttttgaatcatgttctgcaatagcatatttgttgagtggataggtaaataaaatgcccagaaattacccattaggttaaaataatctggtctatccaagaaaatttacaactatcttggttaagaaaatgctgtccctttaacctaaatccttactgaaaagtgattaaaatataaataaccaaagaactgtccactagagtgagttgaatcatggtgcaatgaaaagagagaataccaggaaaagtcttttttttatgctgtagttctacaatttgcaataactaatttgtacataattaaaatagaaattgtgcatgtttttaaaacagagatgaaagtgctacctgtgtatttttttttcttatgggaaatatattacaatattaaaatgcctgaaaacatgaaggtaagtgttggaatgcaaaatattataagacagcatttctttaaagaactgtatagctttctgagttggaataagcctgcctttgcttatgattatttatttagggttcatattccactgtgttgagtgaggatagagcataaaagaggttacttatggcagtgatatttgttaattactgaatgtgtcactgaggctgtttgcggagttttttttacatggagaactttaagagttggtactatatgtgtatctgggatagatatacagattaaggtccatgttgctttcagagatgaaataagatgactttagcacccttgtcaggattatgatttactgattctgaaacaagagcataactggaatgttctattcttttgctatttgccaattagcagaattctattatttaaaaaaacacattgcacatgatatccttactttagaaactactcctgatggtgatggtattgttattaaacactttgtatcaacattatcttttgtcatttatcaaaattttaccacaaagaccacaagataaaccaattatatttaactgattctacttcatttatgaggctttgtgtaggaataatttaagtgtaatggaaaatatgacttctggatgcaaatgtttaataaacatgtgggctgtctagctagctgtgttcgttcaaagctgaagctgttttcctcagaaaatagggcaatttctgttaccaaggtatggaaatagcagtttctataactagaaatttactgcagattcacccagtatccagaacacatgcatgagcaactataaaatcctaagtcaattatttgtctaattgtactttgttacttcttgtgacactgctgaatgccacaaacaacaacaaccaagcagatgggcaaaaacgcttcaaaaggattttagattattttttattgatgtccacacacagacacagctaatactcttccttggtcctctgattcctaaatataggttttgagcaaaagatacgctggttaagaaagactgaagataggtagctggcattccagtggccatttcagttagatcaaatgctaaccaaagttttcaaaaagtgtggcggaaagttttgtgagctattgtttgcatgctccaaccacacttggaaggtttatagattttttgctcttcgtgaaactgactttggaaatctgtctatgctatattttccttaaacctcttttatcctattattttatgattctttctgacattagtaaaaacatctaagcagttaatacaataggataaatttgaggatgttctttgtacatttttgtgtataggaagaagtggccaagatgctttcctcttctggcagatggagagaaggtgctgtctttagtgactgagtgcgagtggggaacctttgattttgtaaaaggctcatacaagttcagatgaaaaagaaatcaatcagggcaatgtataagaagaaaaaacaacctggagactatatttatttttaaataacaattgagttttaaaaatgtcattgatttctgtattttggccagtcacagggaatagagggggaagtgcagggataacactgaaagtaaaaggagagagaggagatgatttattctgagaaagaagcagaggaagtagaagaatgccatcaagaaagacaatgagattaaagaaaaatcactgggtgaatggcaagggctaacatcttacctcctcaaaatagagctctctataacttaataggaccagctctctacatccaatcctcaaaccggtttcaagtggcctctacctgccttatctttagtttcctagggatagttttttcaccatgattttcaaatgatcatagtgattctctaacgattttccctttattcttatgttatcattacctctttgtgttggttttagactcatctctaccagatgttcctcctataagaaacttgggccttgtcttatagttatgctagtccttttcctaatacctgatttttaaaattaccagcataccatatgataaatatctttagctttctaaaatttctttttaaacataccctagtcttctagcagattatttaatataactttcaattctataatttaaaaagtataaaattcagtttatactttttataggaggtgacctcaagtctttgttcagccacaagataaagctggactaaggtccagctttaacaaagatgctaccctgagcgtccacaccaaatccaaggctgtcctcttggtagtctgcctgatgacagaggaaattcagagtcaggcagtgggacttttttggaagacagctgggtctaggggaatttttgtaagcaatgaaccattctttaattgtgaaaccactggatgtggttagtagtttattttaaaaataccatatgttagttcattcctatatactgtgacaatcatagtttaatcaaaagttgcttgtgacatttctgttagtgttcataaaagagtggcttgcttccttgaaatcctgaactctgtgccaaatgccagcacattgacaattacagtttggcttttaggcaattgtgcagctttttgagtatgtggtaagtttttatttatttttgtcactttcactaatttgtcatcttcttaaatggaaaaatattttctcagcactttgtttggtaagtagggacttttactcttttctccatggttccccgagaggaaataagctaatgtaactgcttttcgactcttttttttctggccagaaagccaaatgaatgcatgatctcattgagatacgatctatttgtatgaactgtaagcttgtaagcttgtcatcatccttcatggtcctggggcaggcgcctggctagccactgtaacaggatgaggaaagagatacagcaagatccctgagacttcaattcagtgcagtgcaagtcaattcatttcaattcagctcactttaatccaatctaagaaatatttatggagtactttttaggcatagtcctgggcactggggctatagaaatgaaaatttcatgaaaactgacattttggtgggggaaataacacaaatcagataaatttaagagaatgtggtaattactaactacatcagtatcagtatcaggaaggatgagatgcctcattcatccatccatttcttcatcaaaaatatttattgaaggtctacaccatgtaccaagtactgtgctagatgttggggtgatgatagtgaacaaaattaaagactttctacccttggggagcttgtagtcagtttggagagacactaactaatcaaatacccatacaaaaaaatgttaagttctacctttggtatgtactgttggagtgtggcccatggtgctgtgagatttgataaaaggtaggttctgatcaaggtagggaggttaggaaaggcttctctgagaaagttatgcttgagttgagatctgaaggatgagaaaaaaaaattttggtgaaggctgtaagtgaaaaaaatactgcaggtcacaagaagagcacaaaacaaggctctgggccaggagaaagcatgatgagtacaagagtggttatctaaggcaggccatcaacactgaccaagtatgtgaggcctcattgaggagagttccatctaaaaaataatttcattatctttgactaatatttgaggaaatggccaaggtgggtggatcacccgaggtcaaagtttgagaccagcctggccaacttggtgaaaccccatctctactaaaaatatgaaaattagctgggtgtggcagtgtgtgcctgtagtcctagctactcaggaggctgaggtacgagaattgtttgaacctgtgaggcagaggttgcagtgagccgagatcatggcactgcactccagcctggatgacagagtgagagtctgccaaaaaaaaaaaaaaaaaaaaaaaaaaagaaaacgaaacgtaccaatttcagatgaataattatgtgtattaaatgccatgataaaagcacatctatatataaggcatacagtaagttgaagtactgatttttaacctgagtttaaatggagctttatggttatgattctgtgttttttctcaacattgtttatctgcagaaccactcccaacttctgcttacatcttataaccttttctgcaaatatttattcctatgatatcagtgtgccaaataaagtagtgttttttttttttttttttttttgccactagtgaatctcagcaaaagcttttggcattgacacgtgaggtgcattcttatcttctcaagtggctctatgattttgtctattttcatgtactactccactggcagccaagataatcccttaaggataccaattctacaattttagaagtatagaaggttggaggggcaattcattctgggtgaatatttcagtaacattggctgtaaatcatacccaggccttttctttctgtgactcacgtgatgtaaggaagagatcagatgacgaggtcaagaggacacaaaacctcagccctgcttctgctccctcaatgtcgtccatccaaaatgactttacatatgtcaccagagcatggaagtgtttatggcgatttatactttggttttggtttgttagcttattttgtcatagttaggacaagaggagacatttctgatgcaaagggagattttctttagccagaggaattttgaaacctttattactaagtacaacagagtatttttgttcattgtacttttgaagtctgtgatcaggaaatgtattttctttaaaaataaatcagaaaaggtctcaggagggcctcaatgactgtaataaaatgtttctcagagcactttttatgttttcacactttgcttttttctcctttgctgcaagttgcagttttccatcaaagttattttggatggtgttgaaagttttctctgggtctttgtgcatagttcagagggcattcagggaactgactaagccgcgttaactatatgttgcaaaatgttttatttttgtgtagtgctgtataacatatagaagctttcatacacagaaccctaactgttccatagcccttgatgcaatcagaacaaacattattcctgttttagaaatgcaaatcagaggttcccacaggctaaacaatttgcctggggtcacacatgctgtgttgggagtcagaattagaacaaggtctttggacttctggtctgaccctctatactaactatatggtgaagctgacatagtggagttgttgggctaaaaatgaggagcctttgatagggtgcagtcaaatcttggaggattccattattcatttctccaaagctgggtatattcaaaattagaaaattacagctatgaatagttgttttccacttgattggtctaaagtcaactgaattctagagaaaactcctttgaaagtgtgttgccttggaaatggatgatcgtagcagtataatagcttttaccgtatttgaaattccagcagtttaggtgacagttgtgtctttctgaagggtgtgggcagattctgaacgggcttttcccgttgctcatcagcttggccatggctgctcttattacagcagtcactcattttcacagatgtctttaaaaatttttttttgtttttcttttctgagttcagaacatgtagaagtaacttctttttggcatattgcattgcgtgtctttgcctagcaagtagttggtgttaggaaatgtgcatggacttaagtgggaacacataacatttgtcatgtactatagacttaataaaggctgtcatgtccatgattatgtttaatcctcgtaagaaccttgtgagaaatataatgccagtgttatttttcccatattttacaaatgaagaaagcaaaatttgttaaaaaactattatacagtggttaagaccataggtttggaatcgtagtttgtgtttagatcccagtatactttacttacgagctttttgatggtgggcaagtaatttgactgctctaagtctccattctcgtgatctgtgaggtaagatgataaagaaatatacctcaccaggtggctgtgaaggttacctgagtataaagctttcaaagggcactggcaaataatacagcttagtgtatattagttattatcattaagtaacttaatcacattcacacattagcaaggagaagagctgggacttgaacctatgacctttggttgtttttgagatgaagtctcgctcttgtcccccaggcaagagtgcaatggcgcaatctcggctcactgcaacctctgcctcctgggttcaagcgattctcttgcctcagcctcccgagtaactgggattacaggcacctgccaccatgcctggctaatttttttgtatttttagtaggggcggggtttcaccatgttggccaggctggtctcgaactcctgacctcaggtgatccgcccgcctcggcctcccaaagtgctgggattacaggcatgagccaccgtgcccggcagaacctgtgacttttaactccagcttctaccttgttatttttccaaaatactaggaatttccttctttctcttctctatggcaagtggctgctacattaagttgttagtgaaggggatgggttttggaataaaagacttggggattctgtgagaacatttgacctcctggaataaatcagcaaattacttaaaaatgtagaaacacactccttattattaagagctacttggttctaacccaaactgaacttaaaaacatcccctactctgactcacattattagtatatgaatacttttggatgtaccagttatgtgatgtatccactgtccttagtaggggattaaggatagatgttgggttcccacattataagcccccttgctcccctcaacctttccttgcatggacctggtgagagtgaggggtggagctcataggctcattggggaacaaaccatggtctcatctgcactgtcttctaagcaaatcagttagattaaaagcaaaagaacaaattagcttgagatacttactgaatttggattgccccttgaagtgtttacatttatttccatcctgcctcttctcttccagggatccctgctatagctttttggacagcctaggtaagcatggtggctgctgtgggtgcccaccactacacatctttcacgtttgcctgcaggggtcctcagtgctgcaccatagattatgtctatgtggacaccttcacttgtttaaatgttcacttctctgattataaaaataataatacctgacctttacatagtgcttgacaggttacaaagcatacttgtatacataaatgattctgagggatatttagaggttattatttctgctttacatgagaaaatatagatctgaaaggtgaaatgaattacctccagagaggggacaagtatgagaagtagttaggacttgaacattccaaatctggtgctctttttacagtacctacagtgatatcttctcccagaaatgaattaatgtgttggctagttaatagcttctcacattctacaaaagatttgaggggtcttgaaataataaaatatgggtggaaatagaaaccaaaccagggagaacacacaatatccagaaccactaggattaatattgttcctacagttgaatttaatttgtctttgagcttcctggcagccaagataaaaagaggcacaatcagttacatatttcttattagaaaaggaaaaacatgctacagagaagtggagattttactaggattgtattcaaaataattgttttgcttgaggccatagataaggagcaataagaataaatgaagataatgctctcaacaaaaatttgtagctactcaataacataaaaatgcattgcaagggggctaacatttgctgggtgcctattatgtgtctggcactctactagtgcatattttattttattctgcatattttattttatttaaccctcatgaacatttaatgatcacaactatcttttaaaggtatcattgtgaccatttaatgataaggaaactcatcctcaaataatttaaactatttcttcaaggtcacgtagctagtaaggagtaagccagcaattgagatccagaccttgtctgattctacagcctgtgtcctcaccattctattcatgctgcctataatgtgttagagacataaattaactaaatgcaagtatatataatcttctagtgtttctactttatccaaggatatgttttacaggacccagattataggttggtcttctgtaaacatcatttctctcatctaggcttcagtaggaggtgagttgtagaaaagctcatgtagtggtgctgcttgagagtgtttccccagagtgttaactgtggctatgtgttgttgttattgaatattaagcactttatacactaccttctttagtcttcccagaagcccaataaggaaggtacttatttccattttgtagataaggaaagtgaggctcatggaggttaaatgactgaaagacatacaggttctcagtggcgggattcagacacagatcttcctggctctaattagcatgtgctttaccattgtactagagggcgtcatgttaagcaagtggtaaagttgttaatctcttgaaaaaatggatctggactcttgtttggaagaaagaccatcttgcctcagcactgagatgactgcaggaggacctagagacaagtttgaattttcctaaaaaggcagttgggtcagcctcggcatgtggtcgagctttatgtgcacagttccacatcataacgcatgaaggatatgactttgacatgaaaagtgttcaaagatgctgttcctgatgatttttcacaactacaagaaaaccttaaaaatatttcagtggattttattttatggggtctctgaggaacctactaaggtgaattaagtactagatatagcaatgtcacaaattgatttgaacaaatttaattttgggaaatgcagccaaaataataattttagtttagaatggttaatttagaatggttctttttgacagtcattaaataccagaataaattatgtgaaagatgtcactccaattttgtgattgttctcataataataactgccacgtctaccatcactacaataagaataggtaatgctcactgagttttgttctgaatgcttgataagaaatagcttagttaagcctcataacaaccctatgaggtagatataattattaactccattttatagatgaaatgtagagaagtgagtaatgcacccaagggcattcagcaggtaaatggctggctcactgcactagtctgtctctacatatatagtggatcagataaagatatacatgcccctcttcttcactgtgggggagcatgaaaccagttcatatgcaagtacttttaaatcattaaaagcagaacttaaaaataattggggcaggaattcagaagaagcataatattgcttgcttagttatgaggagaccattcccgaccaccctaattcttgcagtgggagaaatgtaaaaagactggatgtctctattgagctcctgtagtttggttcatagttggtttcagtccccagggccaaaagctagttaaagtttggaaaaggtcagtctcatgacattgttcttgatacgtttcctcacaaggtaatgcatagtgtttgtattactgatagtagggtggttttgggtaaagccgacttgctccttaaactgaatattagactgaggattctagaattcttttttttttttttttacaaaacaaaaaattggcataaagttttgaaagcatagataagtagttgagaagtagctctgagaagcatatgtgtcaagcgttgcatgctggaatcagattgacctggttcagatgcatgcccttgaaccagttaactaacttctttaagtctcagtttctttatctgaaaaatggtggtaatactgtctgactcatggaactgttgtgatgattaaatgagataatcaatataaagtgcttagcctaatgactgacatataaacttaaagtaaatacagttgaaacttgaacaacatgggagttaggggcactgacctaacaccgtcaaatctgtgtgtaactgttgactcctcagaacttaactactaatagcctactgttgaccaatagcataaacagttaatgaacacattttatatgtgtattatatactgtattcatataataaagttagagaaaataaaatgttattaaaatgtcattaagagaatcgtaatgaagaaagaatatatttactactgattaagtggaagtggatcatcacaaaggttttcactgtcgtcatcttgacattgagtaggctgaggaggaggaagaagaagagcggatggtcttgctgtctcaggggtgacagaggaagaagaaaatttgcatgtaagtggacccatgcagttcaaacctgtgttgttcagtggccaactgtatgtgccatatgagatttcccattaaaaatggtataaactaggtactgagttcattcagatagaattaaacatgaagaaataaaacaaatagtttgacaagcagtgggggtcactaaacacaacattcctaagtaattcagttgtcagaagtgcagttcccaaatgcagttagtatctttagaggagttagaagttctgattatcaggctctgtagaattttttttcatcctgagagagatgagggtgatcccatgatagagcagagaaaacactcaagaggtggagttctagcctagctgtgccttttactagctctttgacttttggacacttcgtttaatgtttggggcttcaagttactgagcagtggaatgaagagtcagtgtggataatctctacatttcctaccagctctcatattcttttattctaaattagtttaggtcataaaaaactagataaattagtcagtgaaaaaagttgccagaccttctccaaatagtctcaaacaaaacagagaggaaataaatgcaaaataaaacaaaaactcaaaagtagtttgctgaagattctgtttttttttctaaaatgtccatttgaggccaaatgaccccttcttgtctttcattgattcctttggagaaatgtcctcagctcattcataggcctaggatgttttgcttccttccttgattgaaaaagtttctttaaaaaattctttcactgccacagcaggagtgaacccaaaggactcaggcacaggaaatgtctttgctttaattgttgccagtgccagtacagcccttttccaagttgccctgagctgtcagcagagtgaaactatgaatgaatcaaatgaatagggaagataagtctaaatagcagaacacatttttttttccctccaaaagaacaactttgtcttgagcaaaggatcatttaaactgaagatgcagttggcatggtgccttggaaaggcttgtcactttctttctacaatacttcctgaaaagttttcctttcatttgagacttgttcaaactggttatcataatttaccttaaaatattggtgacagggggtgatggttaaacgtaggatagattctataactggttctttgcctttcaaggtttcaaggtagtaaggttttcctcagaaaaggagctcttttttctttgatagtactttgagaatagtagtatcttttagcaggcagacacatcacaaattacctatttaaacctccacatttaacaggtgaggcaactgaggacaagtgatttggccaaggtggcacaaacagttaacttaggccttcggccctcaagcaaatgttttcagtaccacaccacatttccttcctatattgggctgcggcttcctagttcttacataataactcaaacttactgcatcagtaaccatttcccaccaacattagaactttagaagagtagaaagatttttccatctttctgaaggcatgcttctaaatgaagttgaagctggtgatttacctctgttaaatccacgagatgtggctgccaggctctcctgaaacgaatgaacatgagaataacaaagtgtaaacattcatgactgaactgcagtttccaagacaattagcaagccagatccaagtgcagattgaggacccaaagaaggggagacagtatggcagtcattctggagtaatcctgcagcactacaaactggcataatacagcctttttaattttgagaaactttttattttaaaaagattatagatttgtaggaagttgtgagagatagtacagaaaggtctcatgtatccttcagtccatttccccaatggttatatcttatataattagagtgtaatatcaaaaccaggaaactgacattggtacgatgtgtgacatcgtatgatgtgtgacattggtgcgatgtagttacatataattttgtcatgtatacattcatgtaactactaccacaatcaagacacagaagagctccatcactacagagatcttcgttgggctatctctttatagttacaccccctcctttcacaccatccctatccctggcaactaccaatctgttttccatctttgtaattttgtcatttcatgaatgctatataaatgaaatcatatggtatgtgaatctgctttttttttttttagatcttcttctttttttttcccactagcatagtgcccttagttccatctaagttgttgcaaatcgttcattatttttgttgctgagcagtattctgtggtatggatgcaccacagtttgtttaaccgtttacatattaagaggcatcttggttgtttctggttccaggcttttgaaataaagctgctggccaggtgtggtggctcacgcttgtagtcccagcactttgagaggtggaggtaggtggatcccttgagcccaggagttcgagaccagcctgggcaatatggcaaaaccttgtctctacaaaaaagacaagaataagccaggtgtggtggtgcacacctgtggtcccagctacttgggaggctgaggtgggacacttgagcccaggaggtcgagtctgtagtgagccaagattgtgccactgcactccagcctgggtaacagaatgagaccctgtctcaaacaaaaaacaaaaaacaaaacaaaacaaccccaaaacaaataaagctgctatgaacaattgtgcacacgcttttgaatggacattagttttcatttctctgggataagtgcccagtagtacaattgcttggtcgtgtggtgaatgggtgttttatttttaaagaaactaccaaactgtttttcagagtgcttgtatcattttgctttctactgacagtgtatgagtgatctgatttctctctactctcaccagcatttagaattatcattatttttttattttagctgttctgatagttgtatagtgataatcttgtagtcctaacttgcatctatttccctaatggctagtggtgttgagtatcttttttgccatctgtgtatcctctttggtgaaatgtctctttatatcttgtgcccatttcctactggcttggcttcccttcccttcccttccttttccttcccttttccttccttccttccttctctttttctttctttctctttctctttttctttccttccttccttccttccttctttctttctctctctctccttccttccttccttccttcctctctctctcattcacttctctctccttctttctctgtttttctttctctttttctctcgctctgtctttttctgttgagttttcagagttctgtatatattgtaaatatgaattctttgttagatatgtgatttgcaaatattttctgccagcctgtagcttgtcttttttctgcttcattgaggtatagttaacaaataaaactatataaatttaaggtgtacaatgtaatgattttatatacatatatgttgataaaggattactgcaatcaagttacttaacacagctaccacctcacctagttactgttgttttcttcagtgagaacatttaagacctacttgtagcaaatttcaagcataccgtatgatattgttaactatagtcaccatactttatgttacatcccagaatttattcatcttataactgaaagtttgtatccttggaccaacatctccccattctcccaacctcccagcccctggtaactgcccttttactctccgtttctatgggtttgactttttttttttaattacacataaaagtgagttatacagtctttgtctttctctttcttacttatttcacttagcacaacgtcctcaaagtttattcatgttgtcactagtagcaggattttcttcttttttatgtctgaataatattccattgtatatatatcacagtctatccattcatctctggatggacactttggtcatttcgtgtcttagatattgtgaataatgctgtggtgaatatgtgagtgccaatatccctttgagaaactgatttagtttcttttggatgtatcccagtagcccagaagtgggattgctggatcctatggtacttctgttttaaattctttgaggacattccatactgttttccataatggctgtaccagtttacatttctgccaccaatgtctaagggttccctttgcttcatatcaacacccacctcttgtctttttcataatagttatcctaacaggtatgatgtgacagatgtcttattgtggttttaatttgcatttccctgatgattagtgatgctgaagtcttttcttgtacctattggtcatttatttatatgtcttctttgggaaaatgtctaattaggtcctttgtccatttaaaaaatgagattgtcattattattattgttattactatttttgctgttgagttgtatgagttcctaatatgttttggacattaatcccttatcagatatatggcttgaaaatattttctcccattccataggttgcttttcatttttttccagctttattgaggtataattgacaaataaaagctgtacaaatttatggtatacagtgtgatattttgattaatgtatataccgtgaaataattaccataatcaagctaatttacatattcatcactcatgtagttatcattttttgtgtgatgagaacacttaagatctattcttttaggaattttcaagtatacaataaattattattaactatagtcaccttgctgtacgatagatctccagaacttactcatcctgtctaattgaaattttgtaccctttgagcaacacctcccattcttcccacccatcccaccagcccttggcagctgccattctgctctctgcctctgttgagtatgacatttttttttctttaagattccacatataagtgagatcaaggaatatttgtctttgtgcctggcttattccactaaacataatatcctccatgttcatctgtgttgtcgcaaatgacaggatttcctgtttttcaaaggctgaataatattccattggatattatatatctatgtatgtatatatacatatatccgtatatgtatgtattatatattttatccatttatacttgtgttgattccatatgttggctattggtgaataatgttgcattgaatatgtgagtgcagatattaatatttccttaagatagtaattttgtttcctttggatgtatacccagaaatgggatttcttgatcacatggtagttctacagctgattttttgaggaacttccattctgtgttctataatggctgtctaatttatattcctattaacagtgtatgaggattctcttttctccacatccttgccagtgcttgttatttttttttatttatttatttttttgagatggaatcttgctctgttgcccaggctggagcgcagtggcatgatcttggctcactgcaacctctgcttcccgggttcaagagattctcctgcctcagcctccccagtagctgggattacaggcacctgccatcatgcccggctaatttttgtatttttgtagggatgggatttcaccatgttgggcaggctgtcttgaacccctcacctcaggtgatctgcccaccttggcctcccaaagtgctgggatcacaggtgtgagccaccctgcccggccaatcttttgtcttttggtaataaccattctaacaggtgtgaggtaatgtcttatattgcatttccctgatgtttagtgatgttgaacattttcagatatctgttggttatttgtatgtcttcttttgagaaatatctattcaagttctttgaccattttttctttggctattgagttgcatgaattccttatatattttagttcttaaccccgtattagatatatggtttatgaatattttctttcatttcataggttgcttattttgctaattgtttcctttgctgtgcaaaaacttttcagtttgttgtagtcccatgtatttatttttgcttttgttgcttgtgcttttggtattatagccaaaaagttattgccaagattaatatcatggagtttttgttttcatctaggagttttatggtttcagggcttagatttgtctttaaactatttcaagttaatcttgtgagtggtataaaataggggtccaatttcattctttttcccagcctgtagcttatctgtacattctcttaaagtgtctttcacagagcagaagttttaagttttggtgaagtctagtttattgatttttttcttttatggatcatactttttgtgtcatgtctcaaaaccctttactaagacctagtcctgaagatttttttctctgttatcttttaaaagattttttagttttacatttaactctataatctctttcaagttaatttttgtattaggtgtgaggtttaggtcaaggtttatttttaacatttatttttcacctaaatatgaaaatatctatatgaaagtgcacaagtaataagttctcataaagttattatgttgcccacttttttttagataatgtctgctacaggaagtggtcactgcaaagaaataaaaaggagagaattaatatatatttgatactttttttgagcagctgaatctttacataagtgagagttaggagatttcaggcagagcaggtatccaagaggtagctctctcaccccaaattttgtttcctgacttgcgtttgcatgctgtgtacttaactttgagttagacaatggatgctcatcacaaagcagatgctagacgttgtgtttagcactgaatatcctgcagtgggcctggagtcacattcaacgctctgcttaagggctgcaaattggggtctgagtccaactttgtatttaatacaatgctgaacaatgattaggcaacaagagtacgtttggttttgacggaaagcataataatataaaagaacactaggatatatgtcaggaggcctgggatctaatgccacatgtgcattaagtgagtttatgtctttctgcaacttgggaaactagtatgagccccggttttctcctgtgtaaaaacaaggggccttgaccctaggcagtctctgaaatctcttctaggtttaaattacatggttctaagaaatttttaaaataaaatggactctggtttgatcttcattttctcttgctaattagaatataaaaccttgatatgagaagtgataattgaagtttaatattgcatttaagtgtaacgtgttagggaaattctccctttggaatacataacacaacatgtattatattaagtgtttaaatatttctaatgctacagtgggttattggcagattcttcctccttcaaaataatttgagagattataatgccacactaaatatagtgatacgttagtattgccaatgaaatgtgaactgtggatttgtcttgaacaatacgtagcactggtgactgaggcaagggtcatttgatctcttttttctctttcttttttttttttttggtttccctttaattttctgaatgagatgactatatgatacaagttatttctttcttacatttatttgggtgacctcagtttttgttcatgcatacaagttctgaaaaagaacatttacttctttttagtgaaccctgttaaaaaaaaccttgagaagtttggcttgagatttgagcagaaaataaattaaaaaatgatctgagttcttaggaaagaaaaagtagccatggctttggtaaaattaaaagtaggccctgtgaaaagccagaaaataattcatttggccattgcagtatagtttatggcaagtggacaggcaactaactgagttaggaaaaagggcatccctaaagatgattttttttttttttgagatggagttttgctcttgttgcccaggctggagtgcaatctcagctcactgcaacctctgcctcctgggttcaagtgatacttctgcttcagcctcctgagtagctgggattacaggcatgctccaccatgcccggctaattttgtatttttagtagagatggggtttctccgtgttggtcaggctggtcacgaacacctgatatcaggtgatccgcccacctcggcctcccaaagtgctgggattacaggcatgagccacggcacccagctgatttttttttttttaaagacaaggtctcactctattgtctaggctggagtacagtggcatgatcagggctcactgtagcttcaacctcctgtgctgaagagatccttccatctcagcctcctgagtagctgggaccacaggtgtgtgccaccacatctggctgatttttttttttgagacagtgtctcactatgttgcccaggctggtctcaaacttctgggctcaagcgatcctcctacccgggcctcccaaagtgctgagattacaggaataaactcccatgcttgctcagattttttaattagaccaaaaaccctgggaatctgtactaatgagtgggacatctgtgactggtgactggatttttccgcaacgataaagggactattacattgagagctgaggtctgaaaatgctgaatagacttggttagtaaatttgatgagtgaaattttattatgaaaatacctgccaagtgttctgtcatgcatttccaaaaaggtatgctactcttcatcttttatgatcacccaaaactgtgatcagtgtagcaacaatgaccagaattctgctgatttgttttatattttggaacatcattgaaaccttcattccgctatctccctcctcccatgatcctcatttctctttcattgccttttgaagcatttgaatgaaaagctgaattccatctttgtgtgctctttcatggcaatgtttttaggagtaggaggagaatctaggtacagagtgtctgcaatagctgagatgtgggcattcctgacatttgacccacggggagcttctctttcttgttgtcagagtcacacagggttgcactaggtttgcctcagttgctttgaatatcttgatttttgtgggtgggaagccaacagaatcttggcaggatagggtgtgaaggccactcttctctaatatgtgccaggtccatagcctcgttaccccagtttccagagaagaaaatgttaggctgtcaggggagtggtttttgagtcaacattatttctatatctccactttctttccttaagagtaattgcactagatcatcagattgtatccattaagcatgtattgctatttacagaaatgggagaccaaatcagattgtgtatgaaactttgattacttttcctctacaacatttccgctggttttgcatgtgttccagagcctagggaacttccctgcagagttcaatgtaagctgatcccaggctggtccatggtgtcatcctttcagacccaagtgcttgatgagctttttatagtcctcctgctgcagatgcctcctccttttgcttccttatgctaaatgaggagagtgaacaatcatcttacaattttctcagcagtcagctttcaggaataaagtcatttttccccctttgtcttgacttctaaagtctaaacttctatgggaaacaacccacggtgataagggtagtaagagtaatgctaggagtagtatgatgtcataggtaaaaattagcctctatcagttatatttcccagaatggaaataaatggcttctacttgtaatttagactgggatcattttagattttatactctttgccagattcattactactcctttaatggtagaaagacttggtttctacttaaaatgtttttcattgaatttgagtataaaaggagtttaaagtccagctaatctctctgtcaccaaaacagaatccttgctgtgatttttctgactgatcataattcacactcccagggccagagagccagttgctttgcatggtggtccgttccatgtgtggatggttttatttgctaaaatgcctttcattacattgactcagagttagccttcctgagattttgaccctttggtcttagttttgctcttcataatgcagttaatccttcttccacataacatcccttgaaaattagaataaattgtaacatctcttagctttgggtgatgtgatgtttttataagctatattctatttatttatcttccttcaagtcattgctaataatgttagataaaacagtatattacttcttcaaggtgatcttggcttaccagtcaactctgtttttacatctttttggctgtttgcatttaaacaaggatgatgaactcacctgtgcaccttggtcttgtaatcattttgctccgcattcttttcttttatatatctgtattcttacattttgggttctgctgattattttgagctttatgttgtcccctggttacctctggtttcctgatgttccctgacttagacactttgggtaactacgtgcccacctacttctctaacagactggtgccctcaatggggaatctgattaggccgttatttagtcatggagtaatattccttagagtgagctttccaactggtgtcctgtagcagtagattacagatgtgctgagaaattgatctctgcagctcttgaagagctgggcagagtctcagtagtctcaggtgtcaggtgcctcagtgtgacattcagatgccattatgtgctccatggtgaccaaagccttaagcactgcatcaaggaatcaacatagagcactggtaagttagtagggcatagggttagatatttgcttaactcaagataaatgatgccgtcatttagtcaaaaaaggaaataaggctttcttggcataacaagttctttgtgaacctatcctgactctcggtaacctcttaggttgaaagaggtgatggtgtgagtgagatgggtgctgtcagtggtgctctgtgtggcgattacccccactggctcacctggggagactgagggcaaattgcctgtattgatcacagtcctctcattcagtgtctgtagcctcaaaaagatgggtggtagtatttcagtcaagtttactgggggctggggcttgatgaagcatcagaacctggaagtatgctgatgtttaacccctgcttatcttgcaggcacaggcaagtgggcaagtgttaggaaaagtgaagtcaacatctggagcactgagaaacctgactgtacaataataaccagctataaaacaattctcagaaaacaattctcatattactctatgagatgtcattgaaaagatgcatttaaaggagaaattaaatattttttttgaactttggctactctatttcaaagtttgtatttagattaaaatgtcatctaatctgtttggtactcttttgttttctagtgaacaatttttgtgtagtgacaagtgttagctatgtttattatgacttttcataacaaaactttgaagcaggaattctcaaatttaaatgagcattggaatcactaggaggtcttgttaaaagttcagatttctggccaggcgcagtggttcacacctgtaatcccagcactttgggaggccgaggtgggtggatcacgaggtcagaagatcgagaccgttctggctaacacagtgaaaccccgtctctactaaaaaaatacaaaaaattagacaggcatggtggcgggcgcctatagtcccagctaccagggaggctgaggcaggagaacggcgtgaacctgggaggtggagctttcagtgagctgagatcgcgccactgcactccatcctgggtgacagagcgagactccatctcaaaaaaaaagttcagatttctgggcttcactctcaaagattttgcataagtaaattggggtggagcctggaagtgttttctaaaagcactccatgtggattcagttggaagtcaacagaagaccaaacgcttaaaagcactggatgtaaaggaccatatgcttttgtactgatcagctggtggatacttagttttgtattgtcaaagggccatttgctttggagacttaggattcttccctagcatgtgtctcttcttgggctgtgttgaaatacagaaacaaccaaccaaatggaattatcacaagcagttttctataactttgtgcaaagttaggccaaacattacatgttgttatggattatgaaattcagaaaacactgcctcctatttgtgtatagctataccattaaacagtattttcacttagtttgtctctgttgatctttataacaatcttgtgtggttagtatttttatttccagtttatgaatgagaaactttaaggttacaagtaaatggtagaagtgttactctaacctttattgttactacttcgaaattaggcaggttttattatgtgccaggcactatgttgtacattctgaaattcattctctctctgaatctttataaaacactgtgaggtaaatgttattattatttttagaattattatgagttttttttttttaacttggctcttgatgaggctaagtaacagtaacttcttgaggtcatgcctttagtcaatggcagagccaagactttagccaggtttgtctgacactggagttcatgctttcactctgggtattgttaaggcagattgcctggcctgattatagtcttctaattagatgtctgtgtcctaagaaggatgagtggtagtgtttctaggcaagttaccagtacacattatacattatagcaggctgccagtatacattatataaagccatgctatacaactcattctagaaagaacagaaagcaacagggagatctaataggaaggaaagcagacattcaaagtataaaaattaaaatgaaatgaaatacaattgtgcatttttagaaaacttgataaaaataggatttcacacgcttcagaagtacaaagagtgggaaaggcataagttgtgatctgcatacattctgataatgttagccattcttcttgaagaagcagtaggattggcctgtgttttataggcttttgagtgttgtttggtgtttcgtttatgggcttatttttccattactaataccagctggcatttgacctttcatgctcatgcctttggcagtatagtctttctaacttcaatgtacagtatggcctttgtgttttaaatcagaaatttattttaatcaaatacatcttgtagtgttgtgctagtgcttttccctcattgacagtaaagtctcattgatgctgtatttactctggatttctttatgcaatttcaaaatgaaaaattttgattctggtggttctggttgtagtccagtgattagtctcaacacaaaagaaataacaaaatgttaattcattttcccctgaagctgactctggactagaagtcaaaacaaaatattttctattaactaatttcatgagaattcaatatgaataaatgacttggcagtatctttttttttaatcccaagttaagcttttctcatgactttatatcatctactactgatggtgatgaaaattcccaggagttaatatgttaccttatcctgatatctttcaattgacatcttgaatgatcagaatgatctttcaatcatttttaaatctctatccactgagatgcatttatcagctgtccatattcatttagcttctaatacttaccaattgcattttaatatcacttgtttctggtagtctaggggaggctgtgtcagaaaggggtagcatgcagaatggcctttcacctaaatggattctatcttgcatggtgacttacttgaaagccatgagtgacggatctgggatatataagtttaggcctatattttgtaagtgattttctttcagagagattccctgaaaatgtcagagcacctgctttttgatagagacagtctatgcagcacttgatggtctagcctgaaatcaaggagtcagagaacaaatatagggtaggggattttttttttttacagagtttcacactgccgcccagcctggagtgcagtggcgtgatctcggctcactgcaacctccacctcctgggttcaaacgattctcctgcctcagcctccctagtagctgggattacaggtgtgtgccaccatgcctgcctaatttttgtgtttttagtagagacgaggtttcaccatgttggccaggctggtcttgtactcctgacctcaggtgatccaccccccttggcctcccatagtgctgagattacaggcatgaaccactgtgcctggcctagggtagggtctttagaagggctttgaagggtgttgtgagccatcaggccagtatcctcatttgagacattttgtgtagttcagctatttattcagttaaaaaaatctccatggaaatgatatgtagaagtctgtggtatttctctcattccatcttatgagttaaaaaaatcaatcctaattctaattttttcttttttttgtatgattggaatcaaaatatgcataacctttgtatctttcagcagaatacaggctggttcttgactttttggtgggctgctggaattacattctaggttctcagactttagggacttaagctgaggcctgggctgaccttgggaatgtgctttgttatacctctgggagtagcactgagcaaagcaggttgggagccaggattccagtacaggcaggaaggagtaaataattaggttagataagaaattatttgccttcctttcagcaggtggacaagctaacaaggaaaacataataaaggaaataaagctcacttaaagagggaaaaggccaataatggaatcacttaaaactttttattgaagaaaatgggattcccttgcactcttgtttgaaatgtgttttggatatgcattgttttatatcagatttggatatagaattatgacattgtccagccataacaactactttgttaattacaactagttagtggatacctgctggtactgcactgtaagtagtaccaacatattctaaatgttcttatataagaactaaaatgttattatgcaagagaaattccctgcttccaaggagttttataatctagcagagagagaacgtgtacatccaacacaagttgagaacacttgcaaagtaacatatcaataagtggaaaaaaaacagtgcaaatggaagtattgagtgattaagagagtgatgccaaagatatggggctggctgaggaaggatctgaattttgaattgggtaacgaaggaggagagaaacaaattggcagacagagatgaggaagaaagatatatgtgaggccataggtttggaagtgaagcaagtcacatttgacatgttagtgacaataagcaagacaacaagcacacaggctaggacaaggcggaacttccatggccgtggataatttgggatgaatttgattattgatttgattcaagggaacagtaggaaaatgccatcgattcttgagtatatgcaatgtgctgaaaatgacagatactggtaattatttaggcagcaacatctatgataggttggagtagtggagctaagggtggagaaagtattagggagctgttttgtaacctagatttaaagtaacgaaggtttagaggagggctttgggaaagtctgctgggttaggaaaaaaaatgagctcagtttttgagatactacttttcagatgtagcaatcatatcctgagatgaccggtcagttactagacaggattacagtttgagagctcaagtcttggccatcgactttggaggcatttgtgcaaggtgatagttcagtaatgcatgtggagtatgtatcatggtggtgactattgagggagaaatgcagaaagctgagtttggaaccttagaagcagctgccagccaagggggtggaggcaggcaaaaagtatagtcagcaaatgagacaaagaggtagtagaagaacacagagaacacccagggaaaccatgcgaggagagaatttcaacagtgctaactgaagcatagaggtcaaggggattgaagacttgagaaagacctattcgacttctcaagggaaaggtctttggagacttagaaaaatttgtttccagtgaagtttcagtgcaaaagtgcatcagggattttctagatactctgcatgacaaggggattaatgtttaataaataaatcccttctgtaattgctttagcacatatgactgggtatctgggttttcaatatttcaagggaaatggtgaggtcactgcagaaaggaattgaggttagatttctcatattatacaaacccatcaggtgatttttatattatgtgggagagaaactctcagagctaaactattgggcctatttagattcacaagatcctagtggctctgggaaaaatctttgggaaaatgtaaaacctgagcagtgttagaaagcctcttctttggtcctgttatttggtttatgttaatgaattagcttggagtatttgtcagagatgttgagttgtggaaaataataaaaatcagattcaaatttaccaaaataattaatatcaatttacatggaagtggaggcaccaaagaattttggtcaagacagaatcaaagctccaaatttaatgacctacagttaacatcatgccaaaagaacagagccattttgtaagaaacaacagtctagttgaataaatggaggtgataagttagatatggtgaagaactcaaattttaaaaggcaagagacactttctcatgactgaagaagagaaatttgtattaggagatatacctaatgctaaatgatgagttaatgggtgcagcacaccagcatggcacatgtatacatatgtaacaaacctgcacgttgtgcacatgtaccctaaaacttaaagtataataataataaaatttaaaaaaagttagttataatgtgggatctgaaataatagtgataagatattcataactgtggccattaaaatccattgacctatagtttttttgttcatgcatgatttttttttttgagacagggtctcactctgccacccaggctggagtgcagtggcaaaatcatagctcactgtagcctggaactcctgggctccagcaatcctctcgtctcagcctcccgattagcaaggactacaggcatacaccaccacagctggctaaatttttgtctgtagtgaaaagggaaaataatgtcttagttttactgtaaaatagtattgccctcataggcaccccaaaagggtcctcagcccacactcctagaattgatgccttaatactatgcaattctcaagttgttattactaataaattaaaaaattaaaattctctttgctgtattttttaaaagagtgaaaatgtactttacaattctatattactttattatcaaattgtgaatgagttattaccaatgttgtagttagaatttcttttcctctcctagtttttatttctgtgggtatagtcggtgtatctatttatggattatgtgagatattttgatacaggcatacaatgcataataatcacatcagcatttatcctttctttgtgttacaaacaatccagtcatactcttttagttattttaaaatgtccaataaattattgttgactataaaaaaaaagaagagaaatttgtagaaagaaaccaaacttctaaatttatcttcgattcaactaattagcagtagtctcaattataaaacctgaatctataatacggtctaacttaggtgtaattagatgaaaatgtagtacttttctggtgagttaaatatgtgatttttgatttataatcacatcacaacaaattggttgagaaagaatgaaggtaaagaaaagattaaattttattttggcctttagctcagttttatgttcagatggtagtttcccagttatagcaaaactgtacttagcccctccttagttctaggaactaagttctaggaagtaaggagggactaagtacagctttggcataattgagggtgtgactttgatgtttctatagattttcatatctctgcaataaaacttaaattgcttatgctgtttctctgatataaaatacagagttttccaatgctctataaaatgtaatttagacagacgaacatgaaactgttcttaaacttggattgcctgggattctgaaatttttctggttatttgttcaaattgatacctgactatgatattcacaacatttcttgattttcccaacagctgctatacaatataggatgtatattgaattgaaataataaataggcgggaaaaaatgagaggaaaaaagataggtacaaacgaaagaggaaagaacaaatgtaaatcatcgaatagttatgatcacatagtgtgagtatgtcttacttttggttttttttgtttttttttttttttttttgagacagtctcactctgtcacccaggctggagtgcagtggtgcgatttcggctcactgcaacctctgccctctgagttcaagtgattctcctgcctcagcctcccaagtagctgggattacaggcacctgccactgcgcccggctaattttttgtatttttagtagagatggggtttcaccatcttggccaggctggtcttgaactcctgaccttgtgatccacccgcttcggcctcccaaagtgctgggattacaggcgtgagccaccgcacccggcctcaattttgtttttaagatttctacctgccaaggcaaaatatgaaacttgactacttacttgattaatacagaccacaacttaaaaacaaatcacttgcttaggagaaacacaagtattatcaacataaaatccagaaggaggctgggtgcggtggctcacgcctgtaatcccagcactttgggaagccgagccaggtggatcacctgaggtcaggagttcgagaccagcctgggcaacatgtgaaacccagtctctactaaaaataccaaaattagctgggtgtggtgatgcacacctgtagtcctagctacttgggaggctgaggcacaagaattgcttaaacccgggaggcggaggttgcaatgagccaagatcacaccactgcactccagcctgggcgactccgtctaaaaaaaaaaaaaaatccagaaagaaataaagaagactttgtataatgcaattaatgacaccttaacaacatcttgattagagaatagtcaagtttcccaaattccactgagctggtttcatgagttggtagactgatggtatcacataaaaagtcctgcaaggtcaattcagtagtggggcttcaggtccagttagataattcttttagaacttaagtttgggataactatttttctttccacctcatgtgttttgaactttcagggcatatattacaacttataacgtatcgctgtcactcttagtctgagcgctcatgttgaaagcacgcactgtgtgagctgtcatctcactgtgaatcagcaggaagggtgagttttcataacatcagtgaaggatgaggtaattattacagaattggtttttggaatacatgataaagaaattctgagaaaaaagtgaaggtcttcagttccctaatggataacaaaggagaacttaacctgacaaaaacgtccaggaagagtttgtatgttcccctaaaaatggaagcatgttagtaacgaccttcaattctttctggaatgagggggaaattccaaaaataaactaaataaaataagcagtaagatttctttgaatttaagggagaagcacattctcccagttaagaaaggtgtcttctgtgaagctgcctagggctacagtcaaacagattccccctgacaggtgtggaacttgtcttcactctgcagaatggcctgttcattgtatttcccttggcatgtgattcaggttgttggagaccttggtaaactcatcatattagatcatgggttgatgtaagttcatgtttggatgttttaaaattggttggaacctggctaggggaagaacgtatgtctacaactggccctgaaagagattaaacatgtttgaaatgttttcttaatggcagtggagtgggtagtaatgtttcttttgctgtgagccagcaagtgtgcctgttaggagagcattcccgaactcatgatgaatcaaagactgattaactgtactttaagtacggcatctggaaattgcttgtgagagagattttgccatcaattacagaagacacatatgtcactggatttaggaccaaagacagggacaaccctttatcaaactgatttctactttactgtgggtcctcttttaatgtaaactttcggacttgctgcttcaaaagtagttggctttcttctgctagtgatatgtaaagaatgaatggtgcccataattgttataaatataatatgcagagttatatttaatttataacataagtcaccagtcaaaaagacagtttagttttttcctatgacaaaaatccaatcttactcagtaaaacaaatgatttacaactcattgcttttctgagactagtatttactgtgctataatttcaggcatttaggtttactgaaggcataaggtatacttttttagatgttaaatttttagatatggttgattgggggaaattaacaatttcaatgtttgaagtggtaaacagctcatttctgcagggagtgataattgggaatgtagatcattggagatggactgaatttaggaacatcatggttgtagatgtggatttaggagctatctgcttagattttgagtcttttcccatgatactctaactcacaggaacggaactgttgctgtatctctctatacttacaaatggtgagggattatctcttgagctgaggggacagattagaccctggagctgcaaaccctaggtgtatatccagcaacccctggactggtactttcattgtgggatgtatacatccttttaaatatcaacagaagaaattttcagaggttttaccttgattttcctaaaagaggaagcaatcatagaactgaattccttttcataattcttcaaaattgattggagaagaaaattgccttttctctcctgccttttcattttgaggaacccttaatgatgtcacttattttaaatcaaagatgcttatttattgcagcatctgctcagtcctccatttcttcctttcctctcctctcctctcctcttcttttctttctttctttttttttacatggagtctcgctctgtcacccaggctggagtgcaatggtgtgatctcggttcactgtaacctctgccttctgggctcaagtgattctcctgcctcagcctccagagtagctgggattatagacgcacaccaccatgcctggctaatttttgtgtttttagtagagacaggggtttcaccatgttggccaggctggtctcgaactcatgtccttacgtgatccaccagccttggcctcccaaagtgctgggattacagtcatgaaccaccgtgcctggcctcagtcctccatttctaaggcattgtatcattcagtggttgtttaataaccttagacaaaatctaaggtttaacaaccactgaatgttacagtggttcaagaatacagtgatacaatggtccaagaattgaaccaactctttttaacctgttttttttttcattttctttctttttataccttatacaaataaaatatgactgtgtttttattttcatagtataaacaatatggaaaataaaaagctatatgatacagagcataaataatggagcagaaagtgaaagtctctcttcaaacatttgccctgagcctactgaagagttattcatctactctcttctctttggatttacacgcatttaaatgtacatgtagaaagatactaacttgtgttttgcaatagataaattgacttgtctcatgtataatgatcaataaactgttaacctgaaaattcactttgtacctcttaatggctggcagcatttctatattaaaagaaacgtggaaaaatagcaaaactctacattcctgaagtttatttttattcagagttgggtgtatttttttgggggggaaccattggtactttttttatacatggtagactaaattataatgttttaaaaatcaaaaggtatttggagagatggaaatatgatttgatgatttctactaactatatgtattgtctccataatattttcttaatttaaaaaagtggttaacttatgtgtgtttggcatatttttgagttgataatctcaaataattcttcacttattacacatacttgaaaatctgctctctcagtttttcaagttaaaagtattctgtccttgtggatctgtcatttcacagacatacctgtttgctttgttggctaggtgatagaaaataaagggcagaacataagaaattatccttcattggatattagttcgttctctcatctggattttaaagtattactggaaaaaaatcctctaatcttctattaaagataagataagttcttacaatgtataggttgtttgtaggactgagaagtattggaaatatgtcttggctcaactagttggccacccttgagagccagtaataccaagtggctaagcttagttgcacccagtggcaagagacattctgaggtttcccatgtattgggaggaggcccaagacaaagaggtccttgtaaaactcagctagagacttggctgtgggacagagtcctagaagaatctacattaactgtgccctgcccagaggcatgctgctacagcctttgtgctgggaaccaccaggatcatggtatgagtttgcgtctccaggtagacactctgagcttcttttgcttactgaccctgttactacccctgagcactgcagctgccgtgtagcatcatacatcttctctgcaaagtcatattacactgagattgttagaaactgtctgtcctttgttttcatgtgtgtggttgttgctgtagaagataattacttatccttacatctagctttctggcttgatacacacacacagacaaacacacacacacacacacacacacacacacacacacacacactctttggcaaaagaaatgaatgtattggtgaatcttttttttttttttttttttgagttagaatctagctctgtcgcccaggctggagtgcagtggcgtaatataggctcattgcaacctccgcctccgaggttcaagtgattctcctgcctcggcctcctgagtagctgggaatacagggatgtgccaccacccctggctaatttttgtatttttagtagagacagggtttcaccatgttgattgggctgatctagaactcctgaccacaagtgatccgcctgcctcagcctcccaaagtgctgggattataggcttgagccaccgtgcccagccagcattggtaaatcttatgtataattttaaaattaaccaatacattcatttcctttggcaaagtataaaaagcataggatttgaatttggaagaccttggttcaagttctgcttctgccacttaatagtactgtgacctttctgaggctctgtttccattttcattccccatcttggttgaggcttgtgagcttcaaatgagataatatatttaaaagcattttgtgaaccataaactgccacacaaatgttgattattgttaatattttatatttagtcttgctggtacaataaaaagttagtaataaatgccccatgagctgtcttaattccagagaagacatatgaactaatatacccagcttgggtcatcaaaaggtatatttatataagggttactgctaagcagtgacaatcacgggtgtgctaatttcatcctgggatctgcaagcagccttaggtggagaaaagaggaggcacagaacagagataaataaaggcttagtttctacacagccttgtgaaagactgtgttttaagggttgagttcaaccattaaggttgatggtgttttatagtacttattgatgcttaaaagtaaaatttatcaatttttaaaagaatagttttatgagtcaccaaatttataaatatggtcaaatgtgtattccacacttttcagagaaattatgtagctcttctggtaacagtgagagtcctttgcttacacagtcaacaacataggaaaagagattcagttttcctatggcaagtttcacatcctggaaaatgttttatcagttggatgctggggccatctctaggttagaaagtgtcaatgggaagtagttcaggttcagatatgggtaggatctgtgcttcctagtttggagaagggtttctgatgatgagttgggatttggttttcattcttctggcctcgtagatgagtggccagtttcatttcattgattggctctatcttcagtttatgtgctcattctttccattggaaactcctttaactcttctgctgaaaatgttctctagggttcaactttagggaaatcttagcaaattttatttattactctagctattatgtttattttcataacagcttttctgaaggaggacatctaacacatctaggtgttcataatgtgagcctcatttgtattttcagagaaaagttttatcttgagtttgaatgaactgtggaattagctgagttaagagactctcatttttgctatccatgaggcagaaaagtggtgtgaaggatatatgacttcagccaattgactactgaccagtctttctattgtttaggccataggaaatagggcatttggagacaggtgctaaggaaatgagtagcacttttgtgtgtgtgtggttgtaggaaccactgtacaccctagaacactttattaagaccttactgcttatgtaattgaaaagacattgattgagctacaggtacctggtcagacattgagagacctgtacttggtctcaggatgctctgtgtagagcttccccaggctgttgggagctgggagactgcttggcctggacaggacccagaataagaagcatggtacctcctataagcctccgagtaggctgtgggcttcaagatggctctcaggatgatcagagaggtcaggagtgtaggcttaagccagggcccagggccaatattctctgagatgagtcaagccccaaccctctctggggtttccagaacaaaggcttgatttggggagccagcgttgtggagagggcagggggcatgtctctaggcattgctggaactgagggagattgtcagagtggctggggtaatgtttgtataatccgtggcagttggtccttcctgcatgagagtgggaggttgaatgtcccttatgggagagtcatacaccagggctgggctggagcagccagccagagggcgttggggcagtggctctgctggggtgaccaaagtagggaaggaaagccacttgttgcgcacaccccattttgattaactgctttcatgcaggatgaggcagggataggatcatttctcaggcccaggtattgatgttttcttaattctttagtctggaagaacttgatgagagggcaggaggatgttaagaatttccttaatcaaacccatttttcatgtctcctagggctaccccttcatctgcacatctgcagagaataacctgactcctctcacttctccagcttttctcacaaggcagttgttactggactgctgagggaagtggaagggaagcctgggagggggctctgatggtggcacccaatatacagggtctggagtcagggtgaaggaggtcagggactagcgtctgccatagcacgggcacacggccaggctaatgatgagcagcatggccaggaagaaggtggctgtgagctgcagccacagcaggactgctgagagcacggcattgaccaccagtgagcaggacacaacgaagaggcatgggatgctgctgctgtgcttcatgacagcggacatgacaggagcagtccatttagccctgcctcagcaccacaagttctgcccatgctgacaagccttccaggaggcctgggccggggccactagcggcatgcagatctagattcaggagcacaccaaaggtgtagaggaagacattctgaagtgccaggggcagctgccgtctcttcatgagcagctctgtatgcagtgacgacaggcttgagatgaggcagtccaggatgaggagcagcaggcccagcggagtgatatgtaggggcatggggctggcagcagcttctggagggggcctgggaagggtgtttcgaaggtcttacaggccatctggtggatagcagacccccgcagccatctgcagcagcagtgcaaacccctgaggtgcagagaagcagtgctggaggcagagacagtggaacagggcccgcttccaatcttgagattgctcagcacgtggtaggtgctggggtccatgtcacactgaagatagatcaccaggttgttgttagtgccatagatcagggctgatcatgtgaagggagcagcttagtgccagagtgggggccccctacagccatgcttgccagcccactagaagggagaaggtgcttaacagtagcttggtcaactcagctccacagctgaggagggctggaaggacacctggctgtccacatggcacagtgccagcatgggggatgggcaccacacgtggcagtagataggagcagcatcaaggtccattacactcatacccacaccagaccttgggtggctggtgtagttagcaaggggagtgggattgcaacatatttacgggaaatcaagttatggagccacctcccagtagggaggagccgtggaacattgccagagaggatactgaggatcagagtcatctgccaactccatagtcagggcttgaagagtaagggactggtggcccttgaagccacagtcttggggccagtctgacggagttaggagagggaagaaggaatctagggtgcaggctgacaaggtgctgtgcacactctgcaggaagggaggcaaggataaaggcggcatgaaagttggagaaaaaatggatgacagccagggaatccagatagtagtgtctctacctgcaggccccagctccttattctgcctccctcatagcatctagagctattcgggctcttgcatagtgactgcaaatagtcagtctttcaatgtcatctccatgttgggcacagcatagcctgagctgcacagattgccagcgcaggtgccccttgcaaagcccaatacagctgatgtcttcagtttggccaccacagccagccaggaatcccttgaggaatggggaggacaatagcgagccatcccagccacctctgctgttgactttgtcttccatgtgccgctgcaggcaatccagctggttctcgagaaatgccaggtccttaagcttaggcagagaatccttgtcatctgtcatcttccccaccaaacttctgaagagcactttctataagtcaaaagtaaggcagtcttagttttattctctatatttgatgtttggtgcactgcaaaagatggcatagcttagtaggatgttattttatttcagttgcaagataggaagggcattgataattgtagaaatggggaggggttacatatatgagtctgaggctgtatatttagtcttctgagctttggaaatagagatgattttttttcagtcttagcaaaggaagtattttaaaatttcagaaacaatcaggctattaataaagtatgtttaagtggtagagagagcaatgcactaagaataatgattttttaaaaatcttgattctgctagtaacttgctgagcctggacaagtcccttaatgtttctgaacctctgtcttcttacttataaaatgatatttctatataacttaaaaggtcccttccagacctaaaattctgtgactctgatttttctctatgctcataatgattctttgcttacttccacagagtatgaaggtaacaggtatcccttatcaatgaaaattacctttaaaagtataaagcagcaaactgtgttgcaaagggaaggtatggaaatgagctgtgaatcttgaacctaatggggttgcctgtagctcattctctttgatgtgcgctacctgcagtgttcactcctggtgtgctgtgattctggaagagaggcactaggtcttgaatgtgtagtttttgacagcctgtttctagatgggacacacatctagacacacatcatttcaatggtgaccttcaagggcaatgatgccccagccttcaatgtgtaactcttaggtaacactaaaattggaacttggcaatcatataggaaaagaggataatgtcatgttaggcctaaatagggtattttggggatggaaaacatcaaagtctatactctacccaagtatagattttggtaaatggattttagacagattgtttttcaagctccgttatgtctccttagactttttcactttttgtagtaatcacttttttctgatgtttacaatattctgttataaatggggcttaccatctgccattaaggaaagtataaaaatcaggctgtgccagtctttttctctccataaagtaatttccatcagacctcattttcctctgctttagtctcttctgcgaatgtggtagtgatcttaagttatatagcttgtaaggtgaggcacattacagatacaaatctgaggatttagctgggcaagggagggagagaaatggtaagaagggaggtagaggagtttattgattactcatgtaatgcttcattgtgagtaaagaaaagcagattggtcatctataataaaatgtagcccaaatggcatttgcacagttgtaaggtttatttcacagcaaatcagtatgcctattagcatttcacacatatccctgtctctctgtcaagaatgtttgcagattctttgttgttcatgcttaaaggcactttttatcttctgttgtcttgctaatggacctcctcttgaaaaacaactcttcctgtctacacagatgaatctcttcatgactactgtgtttcagtttttgattagctccttgggaatcacagtttctgttaggatgagcagaaagaataagatgggaggccgtaatttaacattgtaattcaggatcaaaatcataggcttttgtgtgactttgaagtcttcctgctccttctaaacagaattgcagctatagcatcccagctaggtgtttttcacatctctttttcttcccttcgtcttcttcttttacttccctttcttcttcccctccctcccttttttccttttttccctcccttcctccctccctccgtccttcctttcttctctgtatttaagtacttgcaataaaaacactgacacttgcctgcatcttgaaaaccccagattcagtttcatcaacatctgttgaatgcctattatattcttgattctgtcctaggcctattcctatgcattgtcttatttaatccccataacaattacttgaaaaagctatttcattcccattccatcgatgaagaaactttggcctgattcatagagctagtatgtggcagaggctgaatgtgaaattacatcttctgaattcttcctttactgggtagaaactctgtttcatatgggaagttgtattagggttctccagagaaacagaaccaagagggtatatggagatatacatgtgcgtatatatatttattataggaattggctgttgtaattatggaggctgaaaagtcccacagtctgctgtctgcaagcttgagaccagggaaagccagtggtgtaattcattctgaatccaaaagcctgagaattggggggccaatgtcctggtgtgagtctgaaagcccaagaaccaggagtgctgatgtctgagagcaggagaagatgaatgccccagcttaaacacaaaggtgaattcacctttccgccatctttttgtttgattttgtccctcaccaaattggatgatgtccaagcacattggttgggcaaccttctttactcagtctactgattcaaatgctgatctcgttcagaagaggcaaacctagaaataatgttttaccagctgtctgggcattccttagcccagtcaagttgacacataaaattaattgtcacataattgctgttataaaaggaactataccttagtgtggaagtaagccagctatgattaagtgagaacatgtgaccaaattctgggtccagattctcaatgactgattcagccttgggcaaggttttgacctttgtattttagaatctctactgattaaaaagagatagtaaaagttgtcttagaggagtcttaatctatagctgtctgtatttactgaaaaaccttacttttacaaaattttaattttgtggacaacttggaactctttagttgggaaataaattccagcatagttgttttaatagcactgcaattaatagaagttatattatctaaatcaattgttaacaaatatgctcagttactgggcagaatcttatttgatgggaatatcaatacatatttgttgaatacctactatgtgactgacaccttacattcatgagcttatttaacccttatcatttctgtgagttctcaattacttgcctcaaagaatgaggctcagaggaattaaataatttttccaaggtcacataactagtaggtggtgaagttgggatttggatctttgaatgcacaaaaatagcacaattattactagtgtgggattttcagttagatttaagttccagttctgtctcttactagcagtgtaacctttggtgattgacttaatctatctaaaccttcatttttagattgagctacttaagaggtctgttccattctaaagattcaattgcaactgtccctttagcatggcctgacacagtgagtgaggtatgcaatggcacctgtttataagggtttagcatgttaaatgaaagatgaagcataaagatgaaatgtgagcatttttttcataatgtatgctaaaatgttaaatcatgcagttttagcaaaagatactagtgtgatgcatgtgttatattagacagaactttggagtagagctgggatatgcaaaacctttccccatctttaccactagcacactgtgaatctcagagcatattatttcacttccgtgtcctctgtgtttcatctgttcatgcattcataaaacatctacagagagacagcagtgtgtccaggcacactgtacgaggaatctaggaactggaaaaggagctaacacgtggcgtctattcccgcatgggccaaggaacttatagcctaatgggaggagagacagacatatgaagattttataatgcagtgtgaaaagtggtattacagtgttcagagccaggggaggttttatggaagagctgacaattgaagaagcaatgaagatgagaaggcactctgccttatttatctttatagtaatatttcctaaagcattgagtgcagtgtccaacacatagtaggcactcagtagtgaattggatactgatttgcaagctggacttgttttcaacaaccattccttcctatgtttcttgttatagctcctctacctctttagggagctccacagggactcagttcaagtccctaattctcttagtgacagtacaccagggtggttaagagcataggttctgaagtcagacttcctggtttcagtttctgtctttgctatttgttagctgtctgaccttgagcagttagttagctttctgtgcctctgttttcttgtctataaaatgggataataggctgggcgcggtggctcacacctgtaatcccagcactttgggaggctgaggcgggtggatcatgaggtcaagagattgagaccatcctggccaacatggtgaaaccctgtctctactaaaaatacaaaaattagccagacgtggtggtgcttgcacctgtagtcccagctactcaggaggctgaggcaggataattgcttgaacccaggaggcgggggttgcagtgagctgagattgcgccactgcactccagtttggcaacagagtgagactccgtctcaaaaaaaaaaatcataataatacctagcattattaaatggaaaaaattaaatgcaaagaactttgaatttgaatggagactaagcactaaggatagtaattgcataatgaaagttagcaatttttatttttcattttgatacattttatgctgagttcatttattagagtgccacttcacaaataactcagttacctgcaaaaatagaatttttctgattgacagtgatcaaaaagaaaaggtgacttattttaggaaagatgttgctttttcttcgcctgctcttgctttaaagaatggatcataaggttctggttaatgtcataaggagctcacatgtattttgctaattataagtcatgcttctcagtgacccttttaactgttaaaatgacctccagattctgatttttcttcactctttattaatggttaacaaactgtttaatgcgcggtaggaaagccaagtaagcctgaagcatttagaaaatggcatgtgaattagttgtaaactgtttcagtaaacattaaatgggtggcaattacttaaagtgattgcctaagtttcattaaagtatttaaaagaaaaaatatgtgcttaatgctgccttaattataaggaacttactacagtagcttccatctagggtttaccaaattagcctaattcataacctcacccagggcattgtatgcacatgcattttatacacatttctgatttcccccttcaccccatgcctcactgagactcagacctggtaatctgtgtttttaattatttaaggtgaatcgctgatgagacctggttggaaaacacaggtgttgtctggttaaaagcttggttttgattttgcattcaacaattcaaaaagctcttaaagatacttcagtataactggttaccaagggttaattgtggtgaatatagaatgagagtagctgaggaaatggaagtctgtgatttttgattgccttgttaaatcgtcaacagcagcagcaccaccatcattgattgggttatggcaggaaatgctatagttagatttgctacaaattagtttagatagagagtatgggtgaaaataaggtaatcttttcagatgttgtctgataaatggaagcagtgcattcatgagcagagctgcaaaataaatgttgagtacacctttgaaacaaggttgcctaccgtgaattatagcaaacaaacggaagtattctcaaggtgtgtggaatcaataaaaaccaaagtgtcaagatgcaaagagcagtcagcttgtataggtgcccacaactactaatcataacttgataggtgtggaaagaactgctgaataccctccctcttacactgccccaactatggcactgccctagatagccttctaaaacacacacctgattctgccactccctgcttgcagccctcaatacttttctattcatatgataggataaagtctaaatgccttatcaaagtatatagggccattcaggatttatctactatatactcttatagtcttctttctcttctcttgccacattttcatgttatatgctcaagccaactgaagtctatacttgtaggcttccgaagtgctttgagaaaaaaaatcatataccacattgttctgttatagaccctaacacagtgcctagtaggggctcaatatacatagtagttgtttaataaatgtttattgacaaatgaataaatcaaaacacaattactgtaatgatctcattacatgtggatttttcccttttgggatataagcccatccagagcactatagtgtgcacagttactggcacataatagtcattaagagtttatggagatctggcaaaatggccaaataggaagagctccagtctgtagctcccagcgagaccaatgcagaaggcgggtgattgctgcatttccaactgaggtagccagttcatctcactgggactggttagacagggggtgcagcccatggagggtgagcagaagcagagggggttgtcgcctcacccaggaagtgcaaggggccgggggactccctcccctagccaaggaaagccgtgagggactgtgctatctggcccagatactacgcttctcccatggtttttgcaatccgcagaccaggagattcccttgtgtgcctacaccaccagggctctgggtttcaagcacaaaactgggctgctgtttggatagatgccaggctagctgcacgtgtgtttttttcgtaccccagtagttcctggaaccccagtggtgcctaggaaccccagtgagacaaaaccgttttctcccctagaaagggggctgaagccagggagccaagtgatctcctgcagtggatcctactcccacagagcccagcaagctaagaaccactggcttgaaattcttgctgccagcacagcagtctgaagtcgacctgggacgctcaagcttggtggaggcaggggcatccaccattactgaggcttgagtaggtggctttcccctgaccatgctaaggactggacgtaactcaacacagcacagcaaagtggctgtggctagactgcctttctagattcctcttcactgggcagggcatctctgaaagaaaggcaagagccccagtcaggggcttataaataaaactcccatctccctagggcagagcacctgggagaaggggtggctgtgggtgcagcttcagtggacttaaacattcctgcctgccggctctgaagagaccagtggatcctgacaaggagggttctcccagcgtggtacttgagctctgctaagggacagactgcctcctcacgtgggtccctgacctgcatgcctcctgactgagagagacctcccaacaggggttgacagacacctcatacaggaggaaggagcaggcaggaatctttgctgttctgcagactccgctggtgataccaggcaaatagggtctggaatggacctccagcaaactccagcagacctagaggagaggggcctggctgttggaatgaaaactaacaaaacaagaagcaataacgtcaacatcaacaaaaaggacccccacacacagaaaccccatccaaatgtcatcagtctcaaggatcaaaggcagataaatccatgaagatgaggaaaaaccagcgcaaaaatgctgaaaattcccaaaaccagaatgcctcttctccttcaaatgatcgcaactcctttccagcaagggcacaaaatgggacaccgaatgagtttgatgaattgacagaagtaggcttcagaaagtgggtaataataaacccctctgagctaaagaagcatgttctaacccaatgcaaggactctaagaaccttgacaaaaggttacaggaactactaactagaataaccagtttagagaagaacataaatgacctgatggatctgagaaacacagcacgagaacttcgtgaagcatatacaagtatccatagccaaatcaatcaagcagaagaaaggatatcagagattgaagatgaacttaatgaaataaagcatgaagacaagattagagaaaaaagaatgaaaaggaatgaacaaaacctccaagaaatatgggactctgtgaaaagaccaaacctatgattgattggggtccctgaaagtgatggggagaatggaaccaaattggaaaacatacttaaggatattatccaggagaacctccccaacctagcaagacagaccaacattcaaattcaggaaatacaaagaacactactaagatactcttcaagaagagcaaccccaagacacataattgtcagattctctaagcttgaaatgaaggaaaaaagaatgttaaagggcagccagagagaaaggtctggttacctacaaaaggaaacctatcagactaacagcagatctctctgcagaaaccctacaagccagaagagagtggggcccaatattcaatagttttaaagaaaagaattttcaacccagaatttcatatccagccaaactaagtttcataagcaaaggagaaataaaatcctttgcataaatgctgagggattttgtcaccaccaggcctgccttacaggagctcctgaagaaagcactaaatatggaaaagaaaaatcggtactagccactgcaaaaacacaccaaaatatagagaccagggacactatgaagaaactgcattaactaatgtgcaaaataaccagctagcatcatgatgacaagatcaaattcacacataacaatattaaccttaaatgtaaatgggctaagtgccccaaaaggcacagactgccaaattggataaagagtcaagacccattggtgtgctatattcaggagacccatctcatgtgcaaagacacacatacgctcaaaataaagggatggaggaatatttaccaagcaaatggaaagcaaaaaacaaacaaacaacaaaacttaggggttgcaatcgtagtctctgataaaacaggctttaagccaaaaaagatcaaaaaagacaaagaagggcattacataatggtaaagggatcaatgcaacaagaagagctaactatcctaaatatatatgcacccaatacaggagcacccagatttataaaacaagttcttagagacttacaaagagacttagactcccacacagtaatagtgggagactttaacaccccactgtcaatattagacagatcaacgagacagaaaattaacaaggatattcacaacttgaactcagctatggaccaagcagacctaatagacatctacaaaactctccaccccaaattaacagaatatacattcttctgagcaccacgtagcacttactctaaaatcgatcacataattggaagtaaaacactccttagcaaatgcaaaagaatggaaatcataacagtctctcagaccacagtgcaatcaaattagaactcaggatgaagaaactcactcaaaaccatgtatgtggaaactgaacaacctgctcctgaatgactacttgggtaaataacgaaattaaggcagaagtaaagttctttgaaacctatgagaacaaagacaaaacatactggaatctctgggacacagctaaagcagtgtttagagggaaatttatagcactcaatgcccaaaggagaaagcgggaaagatctaaaattgataccctaacatcacaattaaaagaactagagaagcgagagcaaacaaatttaaaagctagcagaagaaaagaaataactaagatcagagcagaactgccctcactcagcaatgaggagcctgagcaaatgtgcaaggctgtgagagagagagagagagagagagagagagagagagagagagagaaggagatagagacacgaaaaacccttcaaaaaatcaatgattgcgggagctggttttttgaaaagattaacaaaatacattgactgctagccagaccaataaagaagaaaagagagaagaatcaaatagacacaataaaaattgataaaggggatatcaccactgatctcacagaaataccaactaccatcagagaatactataaacacctctagcaaataaactagaaaatctagaagaaatggataaattcctggacatgtacagcctcctaagattaaatcagggagaagttgagtccctgaatagaccaataacaagttctgaaattggaggcagtaattaatagcctgcaaaccaaaaaaagcccaggacctgacggattcacagctgaattctaccagaggtacaaagaggagctggtaccattccttctgaaattattacaaacaatagaagaagagggactcctccctaactcattttataaggccagcatcatcctgattcgaaaacctggcagagacacaacaagaaaagaaaatttcaggccaatatccctgatgaacattgaggtgaaaatcctcagtaaaatactggcaaaccaaatcaagcagcacatcaaaaagctcatccaccatgatcaagttggcttcatccctgggatgcaaggctggttcaacatatgcaaatcaatgaatgtaatccatcacataaacagaaccaatgacaaaaaccacatgattatctcaatagatgcagaaaaggcctttgaaaaaattcaacaccccttcatactaaaaactctcaataaagtaggtatcgatgggacatatttcaaaataatgagagctatttatgataaacccatagccagtatcatactgaatgggcaaaagctggaagcattccctttgaaaactggcacaagacaaggatgccctctctcaccactcctattcaacatagtattggaatttctggccagggcaatcaggcaagagaaggaaataaagggtattcaattcaaataggaaaagaggaagtcaaattgtctctgtttgcagatgacatgattgtgtatttagaaaaccccatggtctcagcccaaaaactccttaagctgataaggaacttcagcaaagtctcaggatacaaaatcaatgtgcaaaaatcacaagcattcccatacaccaaaaatagacaaacagagagtcaaatcatgagtgaactttcattcacaattgctacaaagagaataaaataccgaggaatacaacttacaagggacatgaaggacctcttcgaggagaactacaaaccactgctcaaggaaataagagaggacagaaacaaatggaacaacattccatgctcatggatacaagaatcaatatcgtgaaaatggccatatggcccagagtaatttatagattcagtgctatccacatcaagccaccactgactttcttcacagaattagaaaaaaactactttaaattccatatggaaccaaaaaagcccacatagccaagacaatcccaagcaaaaagaacaaagctggaggcatcatgctacctgacttcaaactacaaggctacagtaaccaaaacagcatgttactgataccaaaacagatatatagaccaatggaacagaacagaggcctcagaaataacaccacgtatctacagccatctgatctttgagactgtacaaaaacaagcaatggggaaaggattccctatttaataaacggtgctgggaaaactggctagccatatgaagaaaacagaaactgcaccccttccttacaccttatacaaaaattaactcagatggattaaagacttaaatgtaaaacctaaaactgtaaaaaccccagaagaaaacctagggaataccattcaggacataggcatgggcaaagatttcatgagtaaaacactaaaagcaattgcaacaaaagccaaaattgataaatgggatctaattaaactaaagagcttctgcacagcaaaagaaattatcaccagagtgaacaggcatcctacagaatgggagaaaatttttgcaatctatccatctgacaaaggtctaatttccagaatctacaaggaacttaaacaaatttacaagaaaaaaaaaccaacaaccccatcaaaaagtgggcaaaggatatgaacagacacttctcaaaagaaggcatttatgtggccaagaaacatataaaaaaagctcatcatcactggtcattagagaaatgcaaatcaaaatcacaatgagataccatctcatgccagttagaatggtgatcactaaaaagtctggaaacaacagatgctaatgaggatgtggagaattaggaatgcttttacactgttggtggagtgtaaattagttccactgtggaagatggtgtggcgattcctcaaggatctagaaccagaaataacatttgacccagcaatcccattactgggtatatacccaaaggattataaaacattgtactataaagacacatgcacacgtatgtttattgcagtactgtttacaatagcaacaacttggaaccaacccaaatgaccatcagtgattgactggatatagaaaatgtggcacatatacagcatggaatactgtgcagccataaaaaagaatgagttcatgtcctttgcagagacatggatgaagctggaaaccatcatcctcagcaaactaacaggggaacagaagacccaacactgcatattttcactcgtaagtgggagttgaataatgataacacatggatgcagggagtggaacaacacacactggggcctttcggggagtggggtgcaaggggagggagagcattaggacaaattcctaatgcatgtggggcttaaaaccaaatgacgggttgacaggtgcagcaaaccaccatggcacatgtatacctatgtaacaaacctgatgttcagcacatgtatcccagaacttaaagtaaaataaaataaaataaacagtttgtgaatttatcaataacctgatagaattacagactgcagtgcgtactcataaggaactcttatttattcatgctgttgaagggagattggataagctagacatattaaataatagtatgtttgattttcttggagtttataaagttatcaagctgaacagtaactatctgaatcttgagagactggaaatttggctgacttcttttaggtttcttcctttcccacagaattctttgtttctccctctattctgtgccaattggtatcagacctaaaactgatgcagaccctgtggatttaggcagagctgacctgtccagagttactctcctaatagtttacagcccacctaggtttagaagacagttgttttgaactatataattactttggcttgagttggattctctaggaaaacaaaaaatagacaaaagacattgaatagtgattacagtttttaatcatagttttattatgataagaaactgaaaggatgcaaaagagttggtcatacttacctggattcaggtcaagccattgccaagccatggtacaggcactgatgtggacctttttcaatagaggcagagaagacttaattttcagactgggctctaagtacttctggggttgagtacagtataaatatatttacctgaaacatcccttttatttgggtatttggaaagagtatttttataataaggtaaacctagaactattaattttaaatatgaaatgtgaaagtctttaaagacaaagtatggaggtttacagagatattttgaggctgggtggatgccttagttattctgtctgattaaagtgttgaagaacacacacattatactaaagtattggtttgtaacatggaagatttaatgaccatagcatagacattaagtctttgttttttgagttaatcactgagggaaactgaagttccatttcaccacttcctgggtagtgacagtggtacaatctttagcttcactttgttgcataagaaaccagttaggatccaaagctgcaaagaaagatgcatttctgcctttaagaacaagtttaaatcatgaactgctttatttagagccagttggaggtagcatactgctggcaattccaaaccatttaaaaaacaaaagttatggttattaatttttgaagccacaaaagcatgaatcaacattatagcagtgtcagtatctcagtaggaactagtttcaactgaactgtggcagcaaaataaatgtttgcagattgttttgacaaaatgtcatcctctgggcttcaatttatttgccaacagccttacttttgaaaaagtcttgctgcgcttgaagtttagaagaaaaccctccctctgaacattctggaccttaacaaataactctatctgcaagcatttgtaatgtggatctgcaaatgttttaataggaatggaatatgttgctaagagatgtgtctgtaaacatctgtttgacatatttcaccatggtggagattagggatccctggtacccctggtggtacaggccgtttttttaaaaacagaattcacatgtggtttttgaaaattacttatttatttattatgatttttaaaaatttaatttaaagttccagatacatgtgccaaatgcgcaagtttgttacacaagtaaatgtgtgccatagtagtttgctgcacctatcaacccatcacgtaggtattaagccctgcatgtattagctatttatcttgatgctctccctcccctcacctccacagtccccagtgtgtgttgtttccttccctgtgttccacatgttctcattgttcagctccttcttataagtgagaacatgcggtgtttggttttctgttcctgcgttagtttgctgaggataatggctttgagctccatccatgtccctgcaaaggacatgatctcattctatgaatttttttaaagagatagaatcttgctgtatttctcaggctggacttgaactcctgagctcaagcagtcctccagcctcagccactcaagtaacaggctacaggcgtgcaccagtatgtcaggctcacatgtgtttataaagttctctagacagggctgtaacagggttgtgtgtgtgtgcgtgtgtgtgtgtgtgtgtgtgtgtgtgtgtgtactgtcagatgattttattcgtatttttctagtgttcacccatcatttgaagcttaggcacatgcaactctaggaggtgagtttagtccctgaaatgagtatcttttttgaaagttgcttgacaagtgtgaagaaaatcattttccaaagcattaacgtcaattttatacaaaattctgcctgcgtgtgtttatatgcatttcatctgactcttaaacagatctataactcccaaagttagaactgacaaatttataggctaagttgtttgagctctggaatgaatttagatagttcttaaagccatttaaaatcagaagaaaataaattaaaaggaatagaagggatggcttgttgaaaagtaaaggaataatggctcaatcccaagcttagtgtaggaaaagtttaatactcattgcaaagtatttggtaatatatagtccttggatattttaaaaagaaaaacaagcattgttattatcaagattttaacatgcctcattttcaaagagttcaaaccaatggctagatatgtttttgaaatctcctgtttggacagtgggatttagaagggtgccctatgttcacaaatacagtagaaatagaaatgatgggggaagcacactatagcaggaagagtacggactttatggtcagacaaagctacataactgctaagtctagatctccccactactagatatgtgatctgggtaatgtatgcaataacctcattgaatacatatcatatatgaatatagaaataatacttaggttatgggaatgttctgaggattaaaggagatatgttcataataagcgctatttattaatagatgttcttattaagtaatatttctaatctagtgtccttaccaaattgcttggccaggaaaaaatagaaagcaagctgtgaagaatctcttcaataaacctcataactgtcttttgaagaggtcttgcaagtggtgatgaattgaaagaataaaaataaaacttgtgataatggaaaatagaagtataagttttggaagaaaagactgcagtggatgtgtagctcagtttgtacacaccccaaataacattggaaagccaagttattgttctcaaagtctttgctcattttaaatagtaatagattcaagatagaggagaaactgatttctgaagtgagcttgatttcagcatgtaaaaggatacattcttttgacttagttcagaacatgctaatttcataggcaaattaaccaattgtcattcacggcaggacataccatgcagacatttcagaacaattttaattgcagttgacatttttgaaatgaattcttggacataaacatctatatgacatggatgtgtcactgtaggagaaaatttagtgttagctgatttaatagctaaagaatacattttaatatttaggcatattttatattagtgaccaaagaaaaaaaccaattagaaattgactttcagaattctgtttagggaattcatttagctgacatcacaagtaactcttaaatagcccctttggtgtgttttaaagtaggattaggtgaatataacattacaagaactaggcattggccagcttttctttgagtatacaagacagaagtttagagtttacttaactataatttatttttatgtaaaccagtaatggagtctgtaaaaatatttaggttcttgttctgaaaaattaagtttttttttttttttttaaggaacatggttaatggctgatttacatgtgttattttgacatgagttttgttctattgtagtagagaattagacttcctaacatctccactatgcaagagtagagagtggctggacatatcttaggctataacaatcttaatatgtgtgtgttttgggtgcagctcagagataaccaatgttgtttaatattcattggtgtctcttggattgctgattctgttttgtttttaagtcagattactacttaaagaggaaaacttaaatggatatcaataggatctgtgaatcaaaacttgttctgtacataaaacatctagattcatttcagtaagttacccttgtgcatagcttagttcctttcaccacatattctttttatctgtgaaccatcgtgcatatttttccttttcattctgtctttggaaatcctcattctattcatgtgctttatttttccattggattttcaggtttacttaggtctctggagttggttatatgcctttacctctttaggtcactttcactgaggtttatctatcttggccacgattgattggaaattcattgaaaaattcattcattatgcaacttctttaggtagttgttatttaaatactgctagttagtgctcactacacatctttgactaaataacagggtaaataaagggtgagaatatttcttggcattattttttccctctaagaatgtcagattcagttttttcaatctttgtattgaaaatttgttggtattacttctcaaagaaaagatgagatcaaaagtgccagaatcaataatacatcagtagattgcttaatataatagcattatctggtctttctgaatataattttataagccagaatcgcaaaatttgattcctccagccatggatgtacctttagtattctcttcactcttcctgttgttattatatgtcaaaaagttggggaagctgagtcagagggagaaggagggatttgctctgtcagaattgaagctgagcaccagattctggtcttataattcggatcccatcactccacctgtgattactgttgactcagggctgtattatctcatgaagtgagttccctgtgctgccactagataggagtgcatttgcagaatcccatcttttgaaatgaatgtgacgaagatccattttctctgaggatataggaatcagctgctgcaaacacttcattgattacttgggggaaggattggagggtctttagtatcttatgtgaattctcctaaaacttattgggaacaatcccttccccttccacaccacttgcaagcaacagcacttctttaattcattttcatattactagacaacttaggtattcatatttaatatctgccttgagctttaggttctttgactcctacatatcaacactgggttgcttttatctcagcttaccctagcttttcagtcttaaattgacagcgtgacctcaagtcttccttctggtcccttcagatttgctgttgaaatttgctgctctggcatttgcactgtggcctcctcttgtggattttggcttatctcgttcatcaggcccagagcaccttccactgcatttgtaggagttccctgactcattctttatacatttctataactgaatctcagacaccccactttgctgaagatttttcctgcccttctcacgaaagagaggtggcagagggatttggacaattttcaggtgaatgcgtaatctctactttacaaggttgctaaagcgttttaccagtgtaattctaagaaagccagatttgagcttatgcaggtcttaaagagtgtcataaatagtcaaaagtgtttccaaactagcttaagctggtacttgatggatctaaacaaggggttgtctgagaaggcaaaggaatctaagttttatgatcgatagttaattaattggaaattcttcacccagttaaggaatagccaagccttacacgttaccccaagccttagaagtgactaaatactttctctaacagttctttctgaacaggatgctgttaataatcaatctcttttgaaatggcacttacttatctcgccactgatgaactgaggttatctctagatgccttgaagtgttatatataggcttctaatataagggattaagaaatgttgtagagatagaatatagtgaaagcggattgtgtcaaagggggtgaattctttacttttgtcagtattactctgtagaatgcataagtttatttgtagcacacttcaatagaaaattaatatccttagccagcccacatacccactctaatctaggttttctatcagctttgtgtagttaagtgatatgaataatttagaaggaagtttatttctataacaaattatgaacctctgcgttaaaagttggtcctaaaaacttagctgattcaattttattatttactgagaatggatttagcatatctctgttggtcatttgggaaggtgcttaatgaggaaaagcatcaacatttacttgtgtttatatttagactcttgtcattcatatgccatttctcaagcagtcgaactcagtttctacaagtggtctttcagcttctggcctggtttttaggtctttgctgattagtagacatatgttgctggtgtgctgctgtgtgctgctaccacagaataccacagacttggtaatttgtaaagatcagacatttattggctcacccccagttctggagggtgagaaatccaccatcaaggttctggcatctggggagggcctgcttggagtgtcataatatggcagaaggcatcacaaagcagaggggcaaagaaggcaaaagagagcaagagggggtgaatccattccccagataatgtattagtatattcctgggggcagaaccctcatgacataaacacctcttcaaggtttgacctcccaatcctaccacgatggcaattaaatttccactgagttttggatggaaaaaacttctaaaccatagcacaaggcaaatgaagcattatgttgtctgagaacagtgaaactatagatgtcaagtaggaagtgttggaggatctgttatatttattttttctttactgagaatataattaaacttcacaaaagttgaggatcactgccactaattttggaccctcaactcagaacagatctaaataagacagaaaagaagaaaaccttattgtagaatcttgttgacatttctgtattacattcagagttccagcaaaatctttagagcgttaatacatctgtggggaatgtcaccttttttcaaataagaaagaacaggcatccatgtaacatttccttgaggcctccattcctctcccgattttaaaagaaattgtatttttaaaccacacttctcagtattgctatccaggtaatatgggtagaatttttttggcaatgtggggatgaagtcagaagtcctaaagattctttaaggttcggtgcctctatattcttatgcattttgacagagagtctataggaaggagaatgtcttcttttgtatgtgaaagcatccaatggcagcattagtgtggcgcttgtgacagtaatattggagctatatatttagctactctctatagcaaatagttgcactcgaacaaatctgtagagtttattttgggaatcttgaagatttcctaatgttgatgagaattgagtctgactttagaaacctcggggtataaattgttctgataattggtccaagttgaacctggagaaaatgctgatgtgttcactcttaagcagagtgattcatcatgtaaaccttatcatagcagctctggcagaagggagagaagtgatgtagggagtgagaaattaaaagtaactggaaatggtggttataacatgcacaagaaactttcaggtccttcaggaaaaggttgctgggtagccatattctttaccatttcaattaataagtgttttctgttctgtttatagaaagtgtcctttctttccatgcaacttgcttgaaattcccttgaccctcatccccattgttctatgcccatgggattattttttggctttcgtggcttcccagttaagtagcgttcagaaccatggccagtcctggttcagaactggctattctagtccctaaacagcagtaaaggcaagtgctgtaagattatgtttgtgttgaacatatttttgagaaagataattgagattctgcagtttcaaatattgtaaggaagtgtgtggcactaatttgacatgactattctcaatttagcaactaaaaaaccttaattggcttgttttccttataaatatgattttaatgctaattttagaaaatttagaacttgcacataaagaaaacaaggaaaatgagaatcatcagtaattcttccacttaaggataataattgttaacatttagtgtatgtccttctggtggttttttttctatacatattatataagttaataagcctgttgttgcaagtgcaagaaactcatttagaactggaataaacaaacaacaagaaagaatttttttattcactaaaggaaggatctgggtatagctgggtttttggggaaagtaatttgatctgaacaaaaggctacaagaagctaaacacaacaactagaagtaatgattatttagatacttaaggcactgggtaccttgtaattttaacaaggcagatatgccctggtggttaaatgtgggtgaatggatggggttgcatgaattcctcttttttgagtcctcacttagcttttcttctggaaattctctggcatgtgatatgtgtcaaaagacgtaatttgggtctcaatcaggacagcacaatgttctgaactctgtacttacccccaaaattcctgttatccattatgtccatctagacttctttgtctcctggttttgttttcactactgtgttgttttggcatccccaaactactgtgttgttttggcatccccaaactactgtgttgttttggcatccccaaactactgtgttgttttggcatccttgggaacgttgggagttgacatccttggcagagtattgagagtttcatgcttgactctgatgatggtgtctgtgatgcggtaccccttccaggtgtttttttgcagatagagggcatcaacagagggctgtagccaaaagaatcaatatgtgtgaaacatcccttggggacccagcaaattcttgggatgttaatttattagggggaatgcagtcttacgatatgcagatggcgcaattgggtgattaccgtttctgtgaacctatttcttctcaaagcctcatgaataccatgcaaacttggattaagtgaggaaaatggtatcatggaaggtgaaattcggaaaaagtcaaaatgtttagtttcatcattagtttagttacttagtttaggtcaccattgaggctgctaaaaactaaatgattgatttgaattttacttttctctctgatagtcttggaatattgaaataatattaataatatgcttaatataattacaattaatataattgggataattaataaaagaagcagcagaccaaaaaggctgtgggccaataattttttaaacatggaatttcatggaccaaacttactttactgctgtaccatcattgagactacccctttgagaatggcttagcagcgttttaaaaagaaagatacatatttacatcactgacagaaatcctcgttttaattttttaacccactgctttggcagaagttaggaaagaactacacagaataagttatagaatacaaggagtactacctttatgttctaaagaattctaagtatcttatagatatgacctgaatccatgtaacgtttttgtaatgtaaaccccaggtagattatttttctacatttttaagataaaaagctacggtacagatatttcttaaaaatgtctgagtaaactctagtttttatcaccacttgctggctgaaattgaacttactctgctcctaactaaggtagtttgataatattatgaaactcaggctcttaatgctgttgactctctatagctgaataataatatcatggcatattaaggataatttgtgataattgacagcttttcttgagtgggagcttattaatacttggatacctaaatatgtttaaaattatctattttaatgaatactacttggctgtttcagtttcttagctaatttgaaagagaaaaagtaactgtctaatttacttgtctatagcttgctaacatgtaaattgatggtaattttctggattggttggggtaaaggtatgttaaggcatgaagaaaatctaggtaacttgtacacatctctccaaaacttggattccattaaaaaaaaaggttgttcaatgcaattagtttggtgatacacttaacacatggaaattagctctactttaacctgttaaaatggaataataggagggtatatcaggactgttggttgcaaatggcagaaaatttagctcagattgctttaaaacaattttgcttttaatttaaattgtaattgtcaagtatgattgaaacatagctgacttcaggcatgggtggatctaggcattagaaacctacatctgccttgcttctgagttattacatgtttaatttattcttaggtagactcttcccttagagttgcaagatggccatctgtacttcatagcttttattgccattttagcctctcagcataatgattaatttcttagtagttctagcaaaaggctgacatttatttactctgtttcacctatatcaggtcaactgcccactcaaaaatgaattgctgtgtgtggcaagaagttgtgatattctcattgctcagacctgggtcatagggccttgtggattaaaccaaatggttatacaagtataaagatggttctccagaagaaaatgggatgctgtcattagaaaaagagcttaaaggtggttactaacagatgaccactacaatgtgtgtgtgtgtttgtgtgtatgtgtgtgtgttttaaacatttatatgtttataaaactttattcatttagttattctcatttcttttatttataaaggtgaaaatgaagtttgaggattttatatatatatttaagtgtgtttttagagtgttacagtggtctggtaattattattaataagaatgcactaccttatgtctacttagcctccctccatgcctcatgccccttcttcccttattcttgatatcctggaattgcacatcccaataaacattagcacataagctttgcctgagtttctactttctggggaatatgaatggaaaatgatatctatcagacttacttagggggctgtttcaaatgataaatacaccaccgtgacagtcctttgatacattgtatgcttcaagtttataaggatgagaaaaggtgtaacaccacgacattagacttagaaatagttgacctaagtttgatcctaactctgctacttactgtatgacattgagtaatttgctgaacctctctgagcctcattccttcatgtggtcaacaaagggtcagcatgataacatgggttctcagggaggactgcttggggtgcctgtgaatcattaggcaatttacatgcatctccaagcctcagttttctcatgtgtaaaatggagatagtaatacaatctacctaacaggtttgttttgaggattcaatgagattgtcattcatgcgaagcatttgtaaagtgccttatctattatcatctctgaaaaagagtaaaaagctgcctctttgaaagattgtgaagattagctgcattctctaggcagctgttggagccatttggtttaggtctgagcacctgagctattgtaaagcatgacataggtataaaatgatgtctttttctaggggaaacaaaactactgtgatatatttaatacataaattgtggaagttttaacaaccatgatatctacctacaaacttttgtctcacaatgaaaaacagaaatgaatacttaaaatgataactatgtaaaccagttgagaatagcacattaataacttaaaaatagttgtttctttttatactttggtttgaaagctgagattgtaccagattgtggactctgcaaagaagaaaatgtgaaatccagaagtcctcatttaacttgtttaagggaatttatatgtagacttgtcatgctcagcaggaattcttcattgtgatcactatttctattaaagcaatttttttggaagcctgcagggtggccacagtgggatgcttcctataccaaaaccaaaagggtacattcgcaaaatgccttttggtgaataatgaaccaaatttcaactaatttactttctgactatttcatatgccactgtgatttccgtgtcttctgaaatctaatacatttactgcctatattgttcatatagcaatctgatcgtgttttcctttaattcttttaaaaaatgagattaaccattagagtgtggcagctaacaaatgggcttagaaacaacacaaatgggtttgaagtcatatcacttagtagttgtgttatcttgaggaagtcccttaccttcttaggatgcattttccctgtctataagagtaatgtaagggaataataaaagtaactatttcatagacttgtgtaaaattaatgatataacaaatgcaaaacatttaacacatttcctgggatagcgtaaccattcaaaaatattagttattgcttattatagttttatccatagcatttcccctactatgtattatcttttcttctttttattttttatttttatgggtatataataggtatatatatttacggggtacatgagatattttgatacaggcagacagtgcataataatcacatcagggcaaatggggtatccatcacttcaagcatttattatttttttgtgttataaattccaattatactcttttagttatattaaaatgtacaataaataattattcattgtagtcaccctattgtgctatcaaatactaggccttatttattctaactatatttttgtacccattaaccatcccccaccccacctgctcccaccaactaccctttttagtctctggtaaccatccttctactctgtatctccatgagttcaattgttttaatgtttagtttccacaaataagtgaggacgtgcaaaatttgtctggcttatttcacttaacaaaatgtcctccagttccatccatcttattgcaaatgactggatctcattcttttttcatggctgaatagtactccattgtgtgtatatatcacatttcaaaaatccattcatctgttgatgctcacttaagttgtttccaaatcttggctagtatgaataatgctgcagtaaacatgcatgggagtacagatatctctttgatatactgatttcctttcttttgagcatatacctagcggtgggattgctggatcttatggtagttttgtttttggttttttgagaaacttccacgctattctccatagtggctatacattcccaccaacagtgtatgagcgttcccttttctccacatccttgccagcattcattattgcctgtcttttggataaaagccattttaactgggtgatatgatctcattgtagttttgatttgcatttctctgatgatcagtgatggtgagcaccttttcatgtacctgtttcttagttgtatgtcttattttaagaaagatctgttcagatcttttgcccattttaaactagattattagatttttcctattgagttgtttttaactccctatatattctggttattaattccttgtcagatgggtagtttacaaatactttcttccatcttttggttgtctcttcactttgttgattgttttctttgctgtgcagaagctttttaacttgatgtgatcctatttctccatttttgctttggttgtttgtgcttatggggtattacccaagaaacctttgcccagtccaatatcctggagtttccccaatgttttcttgtagtagcttcatagtttgaggttttaaatttaagtctttaatccattttgatttgatttttgtatatagtgagagataagggtctagttttatttttctgcatattaatatccagttttcctagcagcatttatcgaagaaactgtttttccccaatgtatgttcttggcacctctataaaaaatgagctcactgtagatgtatgagtttgtttctgggttctctatttattctgttccattggtttgtgtgtcatttttatggcagtactctgttgttttggttactgtaggtctatagtaaaatttgaagtcagataatgtgatgcctctagttttgttctttatgctaaggatggctttagctattctgggtcttttgtggttccatatagattgtaggatttttttttctatttctgtgaagaatgtcattggtattttgatagggattgcattgaatctgtagattgctttaggtagtatggacattttaacaatattgattcttctaattcatgaacatggaatatctttccattttgttatgtcttcaatttcgtgcatcaatgttttatagttttcattgtagagatctttcactttcttggctaagtctgttcttaagtatcttattttatttgtaatgattataaatggaattactttcttgatttctttttcagattgttcactgctggcatgtagaaatgctactgatttttgtgtacttgatattgtgtcatgcaacttaactgaatttattagttctaatagctttttggtggaatctttaggtttttccaaatataaggttatattatttgcaaacaaggttaatttgagttccttctttccaaattgaatgccctttatttcttctcttgtttgattgctcttgctaggacttctagtactgtgttgaataactggtgaaagtgggcatccttgtcttgttttagatcttagaggaaagactttcagttttttgccattcagcatgatactaggtgtaggtctgttcttctattaatattatattgaggtatgttccttctgtaaccagattttagagggtttttatcatgaaagaatattgatttttatcaaatgctttttcagcatcaattgaaatgatcgtatggtttttgtccttcattctgttgatatgatgtatcacgttaattgatttgcatatattgaactattcttgcatccctgggataaatttcacttggtcatgatgaatgaactttttaatgtgtgttgaatttggtttgctagtattttgttgagaatttttgcatcagtgttcattaaggatattggcctgtagttttccttttctgatttgcctttggttttggtatcagggtaatataagtctcatagaatgagtttggaagtagtctttcctcctctatttttagaaatgttttgggtaggtaaaacagagatatagaccaatggaacagaacagagccctcagaaataataccacacatctacaactatctgatctttgataaacctgacaaaaacaagcaatggggaaaggattccctatttaacaaatggtgctgggaaaattggctagccatatgtagaaagctgaaactggatcccttccttacaccttatacaaaaattaattcaagatggattaaaaacttaaatattagacctaaaaccataaaaaccctagaagaaaacctaggcaataccattcaggacataagcatgggcaaggacttcatgtctaaaacaccaaaagcaatggcaacaaaagccaaaattgacaaatgggatgtaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaaaaagtgggcgaaggatctgaacagacccttctcaaaagaagacatttatgcagccaacaggcacatgaaaaaatgctcatcatcactggccctcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactggttcaaccattgtggaagacagtgtggggattcctcagggatctagaactagaaataccatttgacccagccatcccattactgggtatatacccaaaggattataaatcatgctgctataaagacacatgcacacgtatgtttattgcggcactattcgtaatagcaaagacttggaaccaacccaaatgtccatgaatgatagactggattaagaaaatgtggcacatatacaccatggaatactatgcagccataaaaaatgatgagttcatgtcctttgtagggacatggatgaagctggaaaccatcattctcagcaaactgttgcagggacagaaaaccaaacaccacatgttctcactcacaggtgggaattgaacaatgagaacccttggacacaggaaggggaacatcacacactggggcctgttgtggggttgggggaggggggagggatagcattaggagatatacctaatgtaaatgacgagttaatgggtatagcacaccaacatggcacatgtatacatatgtaacaaacctgcccgttgtgcacatgtaccctaggacttaaagtattgaaaaaaaaaaaaaaagaaatggtttggataggattggcattagttcttctttaaattcagctgtgaaaccattggtcccaggcttttctatgctaggagaccgtttattatggctttaatctaattacttgttgttagtctattcaggttttgagtcttttcttggttcaatcttggtaagttgaatgtgtctaagatttgtccatttcttctaagtttctcagtttattggcatatagttgctcgtagtagtttgtaatgatcctttgaatttctgtggtatcagttgtaatgtctgcctattcatctctgatttcatttatttgggttctctctttttttctcttaggctaaaggtttgtcatttttgtttatcttttcaaacaaccaggtttttgtttcatggatcttttgtattgcttttttaaaatttcatttattcatgctttgatctttattatttttcttcctttactaattttgggtttggttttattttgcttttctataatagttctttaagatgcattgttcggttttttgtttgaagtttttctactttttaaattatcgctttgaataaactttctaccccaatctttctctcccttctctttatgccaataacccttagctttgcccttttaggctgttttctagatctcacaggtgtgtttcattcttttttcttttgtctcctctgactgtgtattttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagatggggtttcactgtggtctcgatctcctgacctcgtgatccgcccgcctcggcctcccaaagtgctgggattacaggcgtgagccaccgcgcccggccgactgtgtattttcaaatagcctgtctgcgagctcactaattcttctgcttaagtctgctgttgagagactctgatgcatccttcggtatgtcagttgaatttttcagctccagaatttccacttgatttttaaaaattatttcaatctctttgttaaagttatctgataggattctgaattccttctctgtgttatcttgaatttcattgagcttccgcaaaacagctattgggaattctctgtctgaaaggtcatatgtctctgttacttgggattggtcattggtaccttatttggtttgtttggtgaggtcatgttttcctagatagtcttgatgcttgtatatatttgtcaatgtctgagcattgaagagttaggtatttattgtagtctttacagtctgggcttgtttgtacctgtcttgggaaagcttttcaagcattcaaagggaattgattgttgtgatctatgactttggatatgatatcgctgcagccatgtctgcgttaggcagcaccataagcccagtaatgctgtgactcttacagacttgcaggtttaccacctttgtggttgtgttaagatctgagagaattccctggattaccaggcagagactcttgttctcttctcttactttcctctgaacagaagaagtctctctttccatttgagctacctggagttgggggaggtgtgactcaagtacccctgtggtcattactactgggattatactgggtcagactcgaagtcagcacagcattggatctcacccaaggcccacagtgaccattgtttggctaccaccaatgttcagacaaggtccaagggctcttcagtcaccatgtggtgaatccagccaggcttgcgtccttcccttcagggcagtgagctgagggcaggtacagaaatgccatgcaggaaccagggcctggagccgggaactttaggaatctatttggtactctattctgctgctgctgagctggcacccaagctgcaaagcaaagtcctttacactctttcttcccctttcctgatgcagaaggagcctctctgcatggcagccactgccccgtgcctggctactgctgatgttcagtcaaggctcaagctggctattcagtcagcttatggtgaatgctgccaggcctgggtttctaacttcagggaagtgggctcttctctggcccagggcaggtccagaaatgctgtctaagagcgaaggcctggaattggggatcataggagcctgcttggtactctgctccactgtggctgagctggtgcccaagctgcaagacaaagtcaccttcattcttccctctcctttcatccagcaggcacttctccccatggccaccacagctgggaatgcactgggtcacacctgaagccagcatagctctggatctcactcaaggtccatggcaagtacttcctgggtacccttgatgtttattcaaagcccaaggtctcttagtcagcaggtgatgaatcttgccaagactgggtccttactttcaaagcaggaggttccctttagcccagggtatgtctaaaaatgtcacctgggagctagggcctggaattggggccttaagactctgcctagtatcttaacctactgtggctaagctggtatccaagttggaagacaaagtcctctttactcttccctctactctcctcaagcagaaggaaggagtttctcccagagctgcactgcttggagttgggggagaggtggtgcaagcactttcttggcttcccaagctggtgtctcgctaagtcatatgcaccccaagtctcttggctctgagcccagtacagcaccagtagaaacttccaggagttgcaaactagtttatgacacacgattttggaattttaatcccccaaaattgatatactggttgctcaggtgcctatatgtaataaataagacaacctatgaaaggggttaggcatggtacctagagaggaagacctggaggtagtgttacatccttcttccattccattttgcagaagtcaccactgagttgctgtctaatgagtagtgattcatgttttgctaaattgagaatgccagactacagagtaatgctctgtggaggagagccgagcagggatatgtagtatctatgctgttttttaggcaggagaccaatttatttttttctgttagaggtggggacaaacctacatcacatctttagaaatggacaaaaggttgattatctgactctagacttctcccttctagaagctaattctatggagtacgtatggacacaaagaagggaacagacacaggggcctacgtgaagtggagggagggaggaaggtgaggatcaaaaaactacctattgggtactattcttattacctaggtggcagataatctgtacaccaaacccctgtgacacacaatttacctatatagcaaacctgcacatgtacgcctatatctaaaataaaagttaaaaaaaattaaagctagttctgatttagggatctttgatgttgaatgttgatgaaaagtgatttatatttgtgattgctagtttcagaaccactacgatgaaaaaagtgactaaacttttggtaatgtgaacacactactccttagaagtattgtccagactccaaattctgcctgtcatttcttcattttcatgccctcctgattgcctaaaatagttagacttcccatttcatgattggaaaggcattgcaaatatttttacattaaagtcctggaactgtagattattttctaccagggatattaagaaatttcaggccaggtgcagtggctcatgcctgtaatcccagcactttggagggccgaggagcggggatcacaaggttgggagatcgagaccatcctgactaacacggtgaaaccccgtctctactaaaaatacaaaaaattagccgggcattgtggtgggtgcctgtagtcccagctactcaggaggctgaggcaggagaatggtgtgaacccgggaggcggagcttgcagtgagctgagttagcgccactgcactccagcctgggcaatagtgtgagactctgtctcaaaaaaaaaaaaaatttctaatcacaaagtaaaacatattcattgtaccttgtatcagtatgtactcaattaccttattttaatgttctgcatacatttatatttagcagatttttttctggtattggtttatgtgctaatttacttatttatttaaagaataaattacttagttaatatttattttccctacatacatgtaaactctgtaagatcagagatctttttgtcagaggctgaagataaagcctgttaagccaattaagagcatagacagtgctcagtaaacatttgctgaatggaatacatgagtgaattgtaaacactttggaatttatagaaaagtgaacataagaaaacagaagccctagaaataaaccatataacactgaaagtgtacctgtgtatttaaatatgcctgtatatgtagaagtccttgctttgtaccgtagtgcatgactgtaaaaaaaagactttgcaaactgaaattatgcaaaacaatcctaataatcaatgaaaacagttactattgctctttgacctttaaaaatttttaaatcactacagtctctcttgttgttagctataaaggtatagggaaatggaaaaaggtaaaactaatatttattcagtacacagtaatttaaaacattagaaatattgatattaaaattgtttcattgtacagtcttatcaggagtagtttgaatagtgcttgccttcttcctgttgtacaacttatgatacagagcatgcattttttttcaatgcctagacaaactgtcatgctctctaaatgtggatcagcttacattttatcctgtgtgctttccatgtcaagaaatgtctcctaaaactccttgaatgtgaagtttttagccagtatcactttctctaggacatcatcatccttttcattacaatcactttccttgtttatgttgattaattcaccttcactaagttcctctaactgcatatacagagtctttcaatggtgaatggcagcatcgtttacattccatgattagctacgtcgtctccatttacgtttgatacaaattttacttccaatagtattaatttttgtttgtgtacattgccttcattcttgttgtccagttctgtctttgattatccatgtcacttgcatttatctttgggagacaagaaggcaacacagctacacactttgctgtctgtgtgtgaactgaacaacaaacacgcagtgatcaatcactgacatattttaaagaaacaccccatgattggtcaatgatcattatgcacacatgttagttacgtagtgatttatggactgaagagctagctgcaaagtttgtactttatgaaattactattaatataccatgttaactgaaatttgaactgtattgttagggactatgttatttaatctaaattgtggtgactgaaatgtacacatatcagactgagcaccgtgagggctgcctcaattcctagctttattttatagaaatatatatttcttgtttctttactaaaatgggatcatttaatgtgtattatttttatttttaattttatatggtatacatgtcaaaaaagtccagctattttgacttcatattttatgattgagtggtatttcattgtgtagttgtaccatactttatttaaccaatcttcctttatggatgtttaggatttttctgttttctcagttataaacaatgctagaatgatcacctctgtcactaaacctttgagataactcttatttatttagaatgaatgtatttctagtacaagaattgttggctcacaggatatatacactatttaaaaattttcatgtcccaccagaaattttcatgtccttcaagcatttccctttagagagatgtttccatttaggctcctaccagtaacataaatcaagaagtgctgggtgcatgattcccaaacccttgcccacgttgggattatcatttttttttttatttttgacatttaattaattaattaattaattaatttatagacagggtcttgctttgtcacccaggctggagtgcaatggcatgatctcggctcactgcaacctctgtctcccaggttcaagccattttcctgcctcaccctcttgagtagctgggaatacaggcacacgccaccacgcctggctaattttttgtatttttttagtagaaacagggtttcaccatgttggccaggctggtctcgaactcctgacctcaggtgatccacccgcctcggcctcccaaagtgttgggatcgcaggtgtaagccaccgcgccctgccattttttgacattttaataggtgaaacacattttattttaatgattagtttcgatttttaattaggttgaatatttttcatgggtttatttgtactaaataaattttgatctatggaattttattctgtcctgtattataatagttttcagatggtagggatttttggttttattgggtcatttgtgtacatatatttctacaaatttatatatgcatgtgtgtatgtgtgtctatccataataaatatatttgtgtgtacttgaactgcattcacatgtatataacattgttggttttacccagggattttgaggagtatttgtgggccttaaatttgtaacatgaccatcaatttccaactgcttttctttctctctctctctttcttttcttcttcttcttctttcttctttcgtcgtcttcttcttcttcttttttttttttttgaaagggagtaacccatgacctgggggaaattctagttaatttttcattgcatgattttcaggagatagggtcaaaaggagctagtagggcattcaattatgtgcttgagtgtgttggaaaatgttttttttttttttctctctccctcaagtgtacaatattttacttgggcttgtttttcaagtgcattgaagtgtgactaaacatttttgggtactaccattctgtaaagaagagggcccatcttgttaaatattccttcatcaactttgcagttagccagttattggcagggagaagcctgcgagggcatgagctttaggcattggacagagggagggtgggtgggaggcggggacttgggggatctcaggattggggtactttgttgtccctcccactgctgtatgaaaaagtgactggttcaagctggcttttgtcttataattttggatgagtcataagtggagaaggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtgaggcatagctgactgtatgtagtactgacccagggaaacaagggcagggcaagatgcttgatcctggagtgccgttctttagccttagcactttgaatggccaatgggcatgatgttggctgggataaggagtaaataattctatttcttcttttcttttttgttgacatgaatgcagggcacctcttatttcactattggggcattgtttcattgatccatgttgctataattttggcttttataaggaattagaaataaagctcaatttatatactatttaatagtaaaatattttagagagataataaactcaggtacccaaaaatgacagccaagagatatgtttccacagtgtccacatgccaagatctcttgtgagattttgtgtgacttattactcattccctgtcaagaggtgggttttggccaggtgcagtggcttgtgcctgtaatcacagaattttagtaggccgaggcaggtggattgcctgagcctagggttcaagaccagcctgggcaacataatgggaccccatctctacaaaaaaaaaaagaaaaaaaaatcagccgggcatggtggtgcatgcctgtggtcccagctactcaggaggctgaagtaggaggctcacttgagcctgtgaggtcgaggctgcagtgatctctgatcatgttactgcacttcaatctgggtgacagattgaaaccctgcctcaaaaaattaaatgaaataaaaaagagattattaaaacaatgaggaaagttgctcttatggtagtccccccaaggttatccacagtttagcttttcatggtttcggttactcactgtacagtacagtaagatattttgagagagttgccacacttatataactgttattacagtatattgttgtatttattctattttattattaattattgttgttagtcccttactgtgcctaatttacaaattaaactttattacgttttatatacaggaaaaaaacatagtatacatagggtttagtactatccatgccttcaggaattcactgggggtcttggaatgtatcccctgtgaataaggggactactgtatttcaagtataaacctgtaatcttttaaatatccagctgaaagtagaaggttcatctgagtttggagtttagaggcccgagtttactttgactctgttgcctcttagtgacaagacactcgatttcctagagctttggtctcattatcaataaagagtggataataatgcctattacatattatatatgtatggtatataaaacatatatgtaaatatagtatacaatgtatttataatgtcacatatatacatacatgtgtatatgtatatgtatgaaaatgctttgtaaattgttaagcattacacaaatacctggggtttcattaatctcataacagagcttttcttttacatacagattcagagatattctccaggtgaatcttctgtgacataaggcaattatgtaatacaaagactttgattataatgcagttgttggtctctcattgtcatcattatgtgctgattccaatgtatttcactttcataaacaagataatgttaagataaacctcttatagtctgtaatttaattccaatcaattcaactcaaccagtgttatttgaatgaatagtttatgtcaggcactgttttaggtaccatgaatatagcagtgagcaaatgaggatcttacatagatctctatcttattaaaaggtttgaagtaagtttaatataataccttacaatatgagaataagggaaaccaaatcattatcccagctttgagtttaagaaaaacaaagcaaagatagatgaaagtcttcttctgtggttatagatggaaaaagtatttatggctgctattttttctacatagacttagaaagaaattctagagtcagaaagaaaatatttttaaaaatcgctttaatcaattagagcagatgagctataaaggagcaataagccaatagcctttccctttatggatgaagagtcttttaagagttagaggaataatttttattttctgaggcatactttaaaatttcttacatcataccacttgtaatcaagtgtttatgaagttaattggattttttgtagtttagttacttaggcttatgctttgtaggcttatggatttatttttatttccacaattttaagtaatattgaatgtctttagccctttgggatttttaatactggagaagcttcataaattaatttatttgataatgggggagaagtttttattcctcaccaagagtttctaggtagcttagtcttgcagaaaaaactgctttaaaaatgtttagaactgatggagaatttcttatctttcataacttaaacaatgcccagaaaaaaagtaattcggctttactcctagccccaacagtagtattagggaaagagacctaatttttaaatactttattttcaatttactgggtaattctctttctaatagacatctacagtgggtgtgattgtttaactcttctgtttgatagctacttaatattttcttcttctaattaaaaaagctttcataacacatttccactcctcatctgtaatactttcttttgaagcttttcattctttgctcttttggggcttcctcccaggatacatcaactgtttcttgttcccctctctcagaaccaataacctgtatagaaaaaaatcctctgtaaagtaaaattttagttcctaaaacatcctccaaaagaaggcttccaaagcaaaagctttttactagtgaatctgtttcattctttcttttccttctttctgatagaaaaatacagtgtgagaattgtcctggtgcagcctgaagtgttgggagattttggtctagtcttggctttgctgctcactagctgtttcactttgagcaagtcatgtagtctttctgagcttgaatttcttttttatcagatgaaggtcgtattgagttgcctcctccctaacattatatatatttcatagctctaaaatttaattcctgtgtgtatactgctacactcagctaagactactttgactttcttattttcatcttgaagttctttgtgagttgttatcatagagtataattcaggtgtagttttctgtttttcatttcagtcaaatgcagaccatacgttattttacataattcctggtcccagaaaggtagagagattatagttcattgtataggtaattcaacattgaatgataggagcataggattttcactcaagatttttaaagattaagatggttttgaatactttaccatccttagagacgttatttccttgggagcacgtgtgccattttgctgatgtagtctgtccccaagacaccctactgctggagaggaagagtgttgggagtgtatcgtgtgtcacgtccacgctgtataacttctctttatagggcttaccgtaattgctgtcgattaattcattatgtatgtgatattattgttttcatatggtctccctcattacattaatttatctgcagagagactaccatgtctgttcactatcatatttctagttcctggcagtgtctgattcataataggctcttaataaacatttgtttaatgtgtgattggttgagaactgattgccttcgacacaactgttctgaatataatactttcttagaaatattaattgaccaaatcagggttctgtataattattctctttctgactgataaaaagctatggaatgaaagacccaaggtacccagaatgccattgataaagcttagaaggggacctatgtttaaagtttcaaactatttcattaatatattgatgatatctgcatttataaaagcacggatataattccttatttaattggaatcaactaatcggagggctaataggattctcaaaattgacatgtctaaaactgaacttcagatctactcttcctaaagatttcctcttctcaatagacaattccattcttttagttcttgagccagaaacattggagtcttccttgattcctgtctttctctacacccaatatctgaccaattggtaaattctgttttacctttaaagatattcacatattcagagatttcactacatctcacattcagtactactacaactctagttcatcccatcatttctcactgagattgctgcagatggctcctaattagttgatctcttttcatctgctcttacttcctttatgaattatctgccatcatctctttgaccttgtcttccttttcatttcctctgcttcactctgcttgagcctcactggccagtcatgctaatctgtcaggaactttggacttgttgttccctctgtctgaaatgttctgtcttccctgaacccccacagttatctgcgtggcccatgtcctcatctccttcaggtctttattcaaatattacctgcttagtggttgtcctatctataattgaaaccttcccccaatgcttcctatccctcatctttcattatttttgtccttagcacctgtcatcatttagcataccatatatcttgttattgtctcttcccaatagaattaaagctctgtgagggcagaaattttcagttgttttgccactgtattcctagtgcctgaaactacctggcacacaggtcatgctcaacaaagactggttaatagaatcaatgaatagagaaatagaaccttgattcttggtttgctgctccacctacattctttggagaggcgtggagtgaatatgcttctggaaatattcagcttttcagtaacctttactatctgggacataccctgctgtcagaatgtttttgcagtaatttttgactcccatttgtgatgtctagtttccagatatgatagttttttccccccattaaaagccctcagacctaccagactaataaaagtttaatgcttagaaggaatccattttacatatgaagatgtgacatgaatctttttctggccaacttataaattgataatattttgattttctgtgaaagtcgcaattgatagcctattttatttcatagagagctaactctccagacttctccagctccatgtaggttctgttataaatctacagcccacagaactcaatatcatccttctttctcttttaagacctatacttttcagttggctaatgatttcttacatattattgagatggctaatgatttcctacacattattgagatgaggaaatctgtaggcagagtagatctgaagttcagtttaggatattcttgtaggatcaggataataatgcatcagcattattatggctgtagtactacttcaggaatttcaggttggccctgtgcctaaaaaaatgagaattgtttcaataatagggggagatgtccccttttaagtcatggaaagcacagtagttatactatgaacaagattaagtatttatttatatgaagtttaaagtaactctcaactctatcaccatcccttttacgtcctttacctgttcttccctttcctaaaagttagaactttgaattttcagtggttcttccaaaatagagcacaagttgaatatggtaaaaagggtagacttatcagacctgaaaaatcgtttggaattggtgaagaagcctgtgcttccattaagaatgtctaggtgactaggtgtcagctaatgggttcataaagcaaactggtaaaagaataattcatgatccaagtttgatgatggcccaaagtcaggagaaagggactttttttttccctgcccaaattctttattcatttgagtagggatatctctgcaaaaatgattattagctgtcagtttctcttcagtgaattttcagatggacagtgctggacttaaccactgttgtatgaatgtttgttaaagataactcccccagcgtaattcaaactgtgctgccaaacttgggtataaaggaaagccatcacaagtttcaacaaacacaagccaacaaaggaaaggggtattgatgttttacttccaactggacaccacaaatgtacacccacttgtgtttctgcttggcagatttacttcaggtaaatctgaagtacctgatttaagggcatggccattaagcaccaacatgtgcacttatactgtgggtttgggcaaagactgctctctcccagtctacactgacttctctgtcttttctctactgaattactttgggaaattctatttcaggccaagttaatttttctgtaagaaaaagactcaaggaatttaatcatctatgtaatcatatatagttatgtccatgtagttgtgtacaataactttaatagtggatctagaattttaagaattctccttaaaaacctcatttttcccaggtacacactaacgttggcttcttttagggtgataaggcacttgttagttagcaagacatttatcatcatttcaatagttgtacgtagttggaatttatttagtgtaaaggtcatgtctgttttccactgtacaactgatatgttattaagttagaggtctttttttttcttaattatatttaatcatatgattggaaagttgcaaaattcagtgattcccagtgggtcttttttttcttcaacaaacgaatgaaatgttgtttgtttggcagtcactgaaaatgtcttaaactgcaaagtattttatcattattcttctaagaccttggaataaacttcacctaataaacccctcctccaaggttaaaacggttttgtaattgcaagtatttaaaaagcctgcttctgaaacaaatttttctgtaacatgtcaagtactgaagcaaaaagaaagtgggaaacttattgcaaatatgtagttattcatagttattatgaaggggagatagtggcttttagtatactattgcaaatatgtagttattcatagttattatgaaggggagatagtggcttttagtatactctacagtaaaaagtctgttttttttttttaaacgtaattgcatggttctaaagcacctttgcagattcattggcacttgaatagggtgaactttggtacttttgccttagccttttctttaatgggctctgatttgaactgagtagttttcagtttttgtttttattttccaaatccaaatttgtccttgatatgcgaggaggctagacaaagcatgtgccatttctggaatgaaactacctgaaaatgatctgtttaaatgggaaagccagtagtttatgtccaaatgcatttgttggaagtataatcagttccttaaacaattagagcaatacattttaaagcaatttaataggcatttttccagagttctccttatgctgtaagctgtgctgtaatatgacatcatcaaaatattcaatatttactgaacttaaagtaaaataaatgctaaactgagctatgagataatatttatcccttataaatatagattttaagaaactggctagttttgagaatttatatttccattcctttatggttaaatcttgacctaaagagctggtgtaatccagaagggtgagtaatactatttcataaatccaccctagtttggatttatgttttgcaaatgcactttttaaatgtattcaaagtcatatttaagtctaaccaggttgcctacaatataaactatggagaggaataaataaaagatggaccacaaagaactgcagtggttttgcttctttttctttttagataaaatcttattaaacttatattatttggacagttgaggattgtctgagcctattcaggctgctataacaaaataccatagactgggtagcttacagacaacagaaatttagttcttatagttctggaggctgggaggtccaagatcaagacattgtcagattcagtgtctggtgagagcctgctttctcacacatggcaccatatcattgtgtctttacgtggtggaaggggctagatagctgtctggggactcttttataaagtcattaatccatctaatcacctcccaaagggcccatctccttataccattcccttgggggataggatttcaatatatgaattttgtggggacatagacattcagaccatagagaggatgatggcagaaaagaactactgtatataagtgaggcttagtttttttttaagtaatagaattggcagtacaggctgttggcagctgatagaagtgggggctcatttaggaaagataagaaggaagtaaaggccttgtaaaacactcccctttacagggcttctagctgccctgtgtcattcatcttgggcttaaattctatgaccaaatattctatccctcagaaaataagcatactcttaggaattcaagagaaatcaaggagtcattacactctttatagatagatgacataattctagataactctgacttgctttcatatatgatgatatcttcctttttctagagtcttatcttgagcaataaattatagcatcatatataaatatgattcatatgcctattaccaacaaacatgcttagcgattctatgagcaagcatgaaaagatgatatacctaaagttaaccaatgtaacattctccatcaaaaataaattagtttcaaaataactctaatcaccttattaccttttacagttttggttaaacccatagaattctttgagtgtgatataaaattgtcgttttttttctcccagttccttttatttctgtggtctaacttgaatcaaagtgaagaaatactaatttagtcacacacacacacacacacacacacacacacacacacacactagaagtctttcattctgttttggaatgtgtcacagctacttttgtagaaataaaccaagtccagttctgaagtttcagaacttctttggtgctatcgttgactttttaaccatgaggtaaacagtaaaaatctcccttcctgcatttttggggaggatacagggagaagaaggagggtcttagaattgtgggtaaggttgatacaaggttaccactaacatgggagttgcctggctgtgagagccttcctgagaggcacatggaggggaaagtctttagatacggctaaaatacttctgaaacatatgggtgctgggcttgattaacattctaaattttctttgacattgtgggctgatcgcttgatctattttcactcctggtctactaatgtgtttttttttcccctcctctgggggtggtaagaggtctataaataataccctatgtagagcttcctctgatctctgccctttgttctcatctttagtgagttaggtgagcgtttagctttctctaggaaaacatttttcaatcattaagcctttgggtgaagaatgtagaaaaacaatttttattccatctttatctctttcaatatctctcagaaggtttaaagtgaaagaagcctttttgttagtatcatgatgaatagcaaaacgatgttgctttcccattttcctttaacagtgtaggaagtgtctgtgtaatatgtgggatataaagtctgtcaaatgtgttttgctctcatttccattaaggttttttattgctatatattgctaagttatcaaaatgtctaggagtcttagaaagcagaagctagaaaagagggttgttccatcgctaaggttaataggatatctcatattatcagaataatctgttgttcaccgagcttgtgtgtatttaaacacacatggaaccagacttgaagggtaaagcttttaaaatcacaataagaggggaatatgcatcagctgagatatgtatattaaaggaagacacaacaaaacgtgccggtcttccttaagcatcaataaaacgaaattttacattcatcttgccacttcacgcatcatgttttttatgtctgcgataaatattggttcatcactgatatttcaccttatttaaacttgcctcatgaaatcacaacagaatcctcacagtggtggctatttttatgcactgtaggctgtacccacatggagaattttgaaatgcatatttttctaccttattaaaaaatttagttaaataattggtcttaaggatctcatggttacatataggcagatataaaaccaaggatgctttggcttctcttgcttggcttttttcttctctaacttcaggggaaggagcagtctagtgcttctctttgggtgtgtttatgaagattatgtaattaatgatctaataagctattaatactccacaaaaagagacattttggaagtgctggaaggggtgaagatggaggggttgagactgctatttctagaggaagttagaacacttttaattgctcttcactaatctcatcttcctaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtgggtaagtatgctgtttgaattttatcctatttttttcggctttccctagccacatgtctccatcaaggcagatgactagtactgtaagcagagttaaatgttttataacatttattctctctttttgcattataacattagtatgatttattgcaagaaaatctgaaaaatacacaaatattaagaaaatagaaaactatcttccataacatcttcctctggtcattgttggcattttggaatatttccttctagctttgcttctcaatcctttccctatgtttttgattttttttattttattttattattattattatttttgagacagagtctcactctgttgcccaggctggagtgcagtggcgcgatctcagctcactgcaacctctgcctcctgggttcaagcgattctcctgcttcagcctcccgagtagctgggattacaggtacctgccacttgtaccttatgtacttcagatgcatgaaaagtgtggggcttctttgcaaatctaactaacaagctctccgaaaaagaaccaagtatatgtacatcagccagacatatgcctcacttgacagctaatctatttcttccaacacaaatgctgcagcattcatattatctataatgtaaagaaatggatgtcatagataagccttttgtctacagatatacaaagaaactttgcagtaagtctaaaattagacaagaatgttacactggtcaccttctgcaggtctttgatccacatcttcttccccataatcccagggtaggcacactgcagaccccttggaaaagtgcagccatccctacaggtccagtgctcacctggttatggaatttcctaggaataagaagtggagcccctgcacttctttttaagaaaaaacatgatctttggcacacctagatctgaaggataatacggcagtttaggccaagctactgatagaaaatggaaacaatggctccagtttggaatgcagtggtgtgtgcccaaggtgttcagcatgatgagttagcattcaacgcacaaagtactaactacaaaggaagccaaagctgccctgcaccatgaggttcagtgactttgatggtggtgatacaaatgatgcttgacaccaatgtgacctgactcaatcacttacccgtaatgtcttgctggatccctgtcccacccagcctttcttcacatgcagctaaaggggcttgacttctgcctacaatcaaccctaacccaggaactagactacttctcttcttacagatgatttaagtcctactttacagatgatgaaactgaggtccagagaaactcagtgcaagtctaagatcaaagaattctagaaatctagtgtctggacttccagtccaatataaccaaggatggatgaataaagagactccatttataatgttaatcttatgctaataagtgaaagtgaatgtaaatctgtgcatacagaatgaaaaataactaaaaaggaaaagtatcgctgggcgtggtggctcatgcctgtaatcccagcacttttggaggccgaggtgggtggatcatttgaggtcaggagttcgagaccagtctggccaacatggtgaaaccccactcctgcctctactaaaaatacaagtggagaagggagaggacttatgtaaagatgctggatggacagaaataattattttatacatttattcagcagtagtacatgggcttctacaatgtgccagacactgttctaggccctgaaatcagggtttgtaaatctaccactttgtaaatgagacaaggtacatgtcaacataggtacaaatctgcatttgtagttagaaaataatggaggaaacaattttatatagcatttttcatattgaacaaggcaggtgaagctgaaaatggaaatctgatatatgagaagagatcttggattatggtacccagggagatcggaacccatctacaaaaacagaagcaagcagaaagaattattttctgggccatctgttccattgtcttttttcattcattaaaagctgcaagaaagattgttatccagaaaagtataatgattggcaacaatcaatccagtttttgagtgaaaattgtaatttctgcattctcagaccttaagaactaacctggagcaaagatgtcaaaaattacacaagttgaaaataaatcaaatgtgcataaatgtagggcaaactggagaagaaaatcatgacttggcagagtataggcagtctaggaggagaataagggtcaccaggaagagtcccttattaaaaaaaacacaattttttaccatagatgatcattactgcctaaattttccccacttagggtttcatgccactgtgctcagggtttgtcctctattaaaatatacttactctatgggaagatgtcatatattaattcccgtgagatacagagtgatgttgaagaaggaatgctggatttaatgttggggagttttaattaaagtctagccctattagcatgtatgaccatgggcaaggccagttactgaactcttttggagtcttcattccctcatctataaaaagaagatgaaggtggacctttcagggttgttatgagcattaaataagatcatcagatgtatttgctgtctacttacatgtctatcccagtatgaatagtttatccagatatttctgcatgtcacctagcagagtgtagagaaatgagtcagatagagagacactcagtgacttcatgaacgggagacaagattccaaatggtatggtagacagagctggaaacagttgaacagcatccctgctgtgcttggaactgatcagcaagggtgatgaaagttaaaagttgaattacacacttggatgttgctgtaaaactgtctttgggatcttcatcaccaggaagagccatcttaaggagcttctggtcttcagcaactaactgaccgttttcatgttgtagaagagagagtaccagattatactggaacgtctttagcgaatggccaaagagagaaggttttggtacttactacatataagagaggttagccaagcattttgtggtttctcttcaatttttcgttactttttattatcagctgtgaactttttctctaacctccatgcatttactttaaaaattgtcattacatgttaaaatttgacactactatgtcactttgaggtatcatcactcactaatatgtttgctctgcagttcctggggcaagcagtcagagagccagtgctgtcattctggagctgataatacagaaaaacagttcagggacaaataacacatcataagtaaaacaaagaggaggaaaagggccagatttccagaagtggggagaagagcatgtttgaaagagtgtcactagctaaaaaacatcttaatcctctgaactaatcaaaaccctacagaggataaaacatgaacgaaacagagcccttatttcatctaaatgacagacaatggcacagtaacttgagaagttatagtcgttatttgttttttaaaaaatccttttgtagcagtgggtgaggtggagttgttttgtcccaaatcatgctgatacttctgagttgagaattatgcacagctaaatcttaagatgcatctccccccgcaccccaattttatatcaacaaatgagaagaaaaagaaataatagcaagcatgattatatcaaacaaacaatagctgcttttcatcttcctttgcagtccacctgctacccctcaccagcctgcctctgagaggcatctcaccctgcaggctcaaagacagcgccacaccatgtgagggccctgcaccatgatgcgcgactgtttaagcaggtgttacttctcacacttacataaaaaattcagcctatttttgattcttctcaggatttctacttgattttttcacgaagaaccccttctgaatgttaatagaaaaatttatctttaaagtattataaaggataaaacatcattttcacagattattttaatagctttattattagtatcctcattgtaattctacgtttaaagagtgtcattcacgtatgaagccgagtctatgggaattttcctccccttttaagttaaaaaaattataagccatttcaggtattttaccatgatgggaagtgaattgggaaaatgtagctctatttttggagtctcatttttatatttaaaggcattcctgagctgtgcatgttggcagatgtattggtcctattgtttcttactttttataacttttacattttcaaaatggcaataactttttttctagtcacaaaactaatgcatgttcatttttaaataacccggaacatattacagagcttttgtaattcctagtcaatactgcaacattgtcatcagaaatggaattgcccattgaatacctttcacatcatgggggttgattcaataagaaacatatattatcttagttaatcttgaagttgaatatttatttatatatttttggccctttatatttcttttaggaatgtttgtgatctttgtccattcttctgtcacatggccatcattctcttggtttgcaaaagctctgcgtatatcaattatttgtttctctagagcttagtttttaaataaagaaaaatattgtgtgacatggggaaagatctaaacttagagtcagaaaacctggttttatatgggagttttgcctctaatcagtccatgtctgtgggcaagtcagtctgtggccctgtgttctcatctgcatagcaagaggttgaacttgatgctccatgaagttcctttcagctctgctatcatctagtgttggcacattctctcccaattggtagtgtctgtgggattttgaacaccgaaggcttaatttcagtgtagctgtgaaatgttactgcccccactttcctttgaaggattttgtcgtttatacttaaagagatccctataatgttggccgttttaatggaaacttaatgaagggcataaagccacacagatgttttaacctgttctaactggtgatttccaggcattagtaacagaggactggctgtgcatacataaagattggtttgagatttcaagggagggtgagaatagagggaggccctgccaggaagggtagataagaaacactttagtctacaaccctgaaattagagtaggagtttgataacactcatagcagacatggtgggactgtttgtttgtttttctggttcttctgtaaaatggactttccactttaaaaggacttaaaggaaaagtagaggggttgtgttttgtaggcacctaattatttactgtggaagagaggtttaattgtaattacaggatcaattctgatagttttgctgagtggggtttgtgtagtttaaaatactcagagctaaaaaccactctaaaccaaaacatttctatgggagaaactcttcctgccttgcccagactccctaccaagtggtcccatgttatgtgacagttatggcacctctgtgaggcatgtgatggaaaatcctggattcagcctctgcttggcttccaaacagttgatagtacattgtgtaaattgccagtttctagctataggctgtgaggccaattctgtgagtgtttagaagatggacttttgagaaattcagtcatgcccaagcaaaacccgttgaacatctgtaacttctctttacaaagaagtgggaatccttgggagatgctgttatcctaccagtacccatcaattttcttgccggcttttggaaaagaatagttattgttcgtttctttacatttatatactaaagtttgcccaagtggaaaatatcagtgtgtgctagatgcatccatgtaccagaaagggagccatgggatccattactcacattctgtgcagaggacaaaaggtctacttgcataccttgagacagactcctaccaatgcatatcttgcacagattctgtaatgttttgtcctcagccccattctggatggagataaatgttggcctgtcatgtagatgtagagtagaatgtaccaggcttcatttatgctatactgctgacatgctgacttgtgagaaagagggtttcttattttctattggcataagaacttaccttccagcagagtgacctatgagcaatttctatgaaacacagtcatctttctggttaaaatcatactaaaaaaagagtaatagaaactttactttttttttggtagtaagactaagatattaaagtttcattaaaaatttcagtcagtttatactttaaaatgcccaatggaaatatactggaaagtcttcagttggatctgaacaataagaataagcctcctttcttagaaaagactacaacataattttgtagtttaatctttctttcattggattaactggtgttcagatgacctgatattaaatactgtttcccttgactgtattctattattaagtacgtataacatcacagaagaatttgggaaaatagattttaaaaatcaacaatctcattacttttaattttctatactctttttaagtttttaaatatcatttatatttctgatatacatttgctatgagtacatgaactttttgactcttccccttttaattgaaaaatataaattactgacttattgtgttacaggataatctgacttatgtgaatacatcatatctgggcctgaaaaaacataaaatgaatactctaatatttgtatctctctcatcaatgcccatatctgtgtaccctgtgtctttatcttttacataaaatgggaaattagaaatttagaaaacaatatcttgctattaaatttgagggtgacatccataaagttagagtaaaaaaataactttgtggtcttgtgactgagttttgttttttgcttttgtttttgtaccagagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtaatgcagaggccagctggctgctgctttctcttacttatttcactcacctttacaccgtctcctgtcatctttgttttaacccttctccatattttttcttttcttgagttcatatgccatagtcatttcatattgacatttttaatccagttggacaggtttgcagtcttgctggaaagatttccacaattgttgtaggctgctaatgccacggtgacttgcttactccatatacatctattctgattgatggaggtggtttagtagtaactctatgatgaaacaattgaatattatagatgagtcagcagattcgtagattattgagtacctctgtgaatatgttttccagcatgtttgccagaattaggaggagaatagtaagatatgataaatgccttgaaatctcctatcacaaagtgtttgcttagtatgtgaaatggtgtccagtctatataaatgatgacttcatcaaactaagcctccatattattttttacctctaataaaaccaatctgctttctgatataggataatgatagatccaagaataattattcaagatgggatattaaccccattatttaacaataagtaaggcactgtatcctatctgtagtttattgatttaccagagtttcctgtagagtgtctatcttttgtatcatggcgtttgtttcaaataaatttcatgattgggagcaatctgagaagggagaggtcagtttccatgaggtatggaaaatgaaggtatgaaggaaagaactactaagcattggctgataggattaggtctatcctcccatcccacccccaggctttttagtgttaagagagatgaggccgggcgcggtggctcatgcctgtaatcccagaactttgggaggccgaggcgggtggatcacgaggtcaggagatggagaccatcctggctaacatggcgaaaccccatctctactaaaaaattacagaaaattacctgggtgtggtggcacgcacctttgtcccagctacttgggagggtgaggccagagaaaagcttaaacccgggagggggaggttgcagtgagccaagatcacgccactgcactccagcctgggctacagagcgagactccgtctgaaaaaaaaaaaaaaagagagagagagatgagtagataagggagattctaattcattgccctcagctgcactttcagaataacataaaaccggttgtcatggaaaaaggtggagtaactgaattgcaactcagccactgcatttctggaaatgagttttctcttagtattaaaggtaactgttggctggaaaaacactacaagcagattttctgtggtatattttttaggcaaaactggttatgtgcaaataatttaaataaaatgctttttattaacaaaaatcacaaaagagaattgaatctgcagtatttctactacagtttgatggttctactgttacctagaatattgctgctgatgggaaatattttggtttttatgtctcccctggctttttttttgttgttttagttgtgtttttggaaagaggggttacttaatggctagaaagttatagaatgagtagtttattataactgatgtcacaaatattttatttaacaatttatatttttgaaattatggcaattaaagttgaagctactcttttatttcttatttaataatccactttcttatgtaagatgaaatcccaatatttgctgatttaattcgtttatcatggggttgggggaagtataaagaagtgaaaaagtgcattgttttcaaatactgctatattttcaaaaagaagtggaatgaatatggcatgcaggaggctttctaccaatatgatgagcttcatttccatggaactgcaggcagagtagaaattaggaacagatggatcttggcggccagaatcttgtgctttaggagaaagtatttggatatggaatacaactaatgagttaatatcgctcgccattcaatctttcatcctatctgtagatctctgtacttgagagaaaagttgaaattgcctttgccatccatcttttcacttgtgaaatgttatatatgctgggcagaaagcaaataggaagggtatgcagttcttttccagctcttcagctgatcagcttacactctgaagtgtggaatatgattagacctttttaaacatgttgttatttgccttaatgctacctaacttcttttaaatatccagaggcaagatttagctttgagagatcctttagcaatgaattttgtatgccttcaaggtacattcttataaatcatcaaatggcaaatttttggctttctagaggtgctcgttattaactggaaagtttgcgtagttacctttatatcttagggtttaattacttaatatctttaaaaaactatgaaatgttctcttagaataaatttctaaacaaacgttcttagaataaatttctaactaaaatttctaataaatggaatgttcttagtttaaatttctatataaaaattatagaattactgtaggtagaattattcctacagttttaatagaccacaatctttcagtctgttgtagttggagctagattctaatatctccatgtaaagcttagataaatttgtatacctttgtctttaatcataggctacaaaatagattcagtgacactgccagctttagttatagctagcaacaatgtaataaataactgaaatttatagagataacttcaaagttgtgaattttttcatttcatggtagtgtactggagtcagctctaatctgctcgggagagccagttgatatcagggatttgcaagctggttgttaaatacagctactattaaaaattaagttatataaacatacaatttaataattatattaaaacaaagataacgaatactgaaaatttattgctttctgcctgtttcactacattttactgtagtctgtgctcttaaggttatttgtatctactgtgtctgtatggtggtagaaatactgttaaatagtgtgccgttgtgcatctcttccctcagtgactatactggtaccttgaaatgggctgttatggtagtatttaccccatagaaaccagcaaatgctataaatcagggcttgatttttaaatttttttttttgaccatttgtctctaggcttaaagaagtgatggagaaaatgctaataatgtagattacatttaaaagtgtaaagtgtctataactgttaaaatgaatagcagaaaaaaattgaagaactttttttcagtaatcaaaaactgttatctgatttaggaaaagagtcagccacatcactgacaaatggatgaagtctgacatattcaatcttcattgtttcacttttgtcttattggttaacatacataataatattaatcaacaaatgtcacaaatatttgttggatatttgatggatgttggaactatactcatttgccagctagcataaccatatgctagctactgatgcaagagtttggccaagatcaactaaagtattgtatgagaatcaactaactatatgcaatttacaatacaatattgtatattttattattatttatataatgtgtgctacatattgttgtaggacttctccttagttcagttaaagacggggttcttgtcacacgaccacgaaaaattaggcttgcacacaatttgaagagtgagaaaaatggaatttattgagcaaaaaggaaaaaaagggaaacagggactctcagcagagcgagtcctggtagtacaggcttcctgccttgcagattgaatcccaggtacacccaggaggaggagcggcccggcttctccaccctgagaacagagggaaattcccaaggctccaccccagtgcgcactcctcccagtgcacaggccggtcagagtttctccaggaacccctctatacttggttgtgacaatatcctttataacagtaaaaatcaatgcatacacatactcacgcacgcacacgttcatgtataaatatggttctttcccctggtaaccggttttcaaacatttactggcacatccactaccagcacactactgtctttattcctaaagactaactctcgtcttttagcatcctggtatggcttggggttcaagacgattttatgtttttaaaaaggagcaaaaaacattttttatctgtaataaatcagggaacagtgaggcaagctttcaaaatgctaattattgtgaaattgctacttgtttgagacatgtgtaaattctatgggcatgcctgccaggtactaaattttaggcaaatgctatcatttctcagtagattaactgaggcatttctataatgttgcatgaagaaattaatgaggttttaggtaattctggtgttggatttttccttacctactttttatttatcactattgttttaggttgaactatatgaaattgccaaaggtaaaattaagttgtcagcaatttcatatgattctacctaataatttggtctgagatacttagctaataattctgtattatttagtgtattatgaaaaagtaatgtttaagcctggaaacattgcttggtagtatttaaaaaataaacatgtatttagtttgctttttattagaaagtaaaagtaaagttttttcttaattggtattcattcaataaatatttagtaagatgtttatgacaagcataacaactgcattttaaaaagttgtggtttataagatgatcagacttttttttaaatgtaccatttaaatgagtactttttatatgtattgtcttatcccaaagcttgcaaaaaatcattgagacctgactttaaggaccaaaaccaatgaggagcctgaatttgagtattcacctttttctacctttgtagaaagttgggtaaagccatcatcgacctgtccctgattttttcctaacttcttcattttttgtccccagattaccataaagatcagttccttgccttccaaggtctgggagtatagatgccctttgctgagaattggctttagtaatctaattggatctagactatggatttcattttcccttaatctaattttacgacctcactttgtattagtgaaaagtttctcttttttcaataaaaaattggaaagataatttagtagttgctcttgatgtctgtgaaagagagataatgaaaagtaagaagaaatgtataaaatgtttagagtggtaactggcacatagtaatcactccacaaatgttagtaaattttatacaatatgtttaagcacaattagggaagaaaaatcttatattgaataggagtggtttctggaatgatacttgctctgtagcttactatttggaaagaaactagcagatatagtgctgatttattccctctgccctttgttaagtgataccaatagtctttcattagcaatgggaggtgaggaagacctttctcatcatagccctcttacgtaataatttgttcccttcattggttttatcttttgctaaatgggtgtcagggggggtcctaaatcacactggaaatccacgacttggtaaagttgtcccatcagggagataaggagctggagacagtggcagctccaaggagagcggctggctcctaggcttcttgctgctttccccatgccttctcctggtgcccgtggtctcctccatatttgtaggcaccccgggcctgctcctgatagaacctctgcatcttatcttcaatttaccaccattttcctcttttttaattcaaatatgagaaatgtaatccacttgctcccattatgggttgccactacttactcctgaatctggactcctctgtttaaggttatctgccaggtgggatgccacttcctagctgtctcccatattgctggtttgatataaacacacacacctttaggtatttttaaaagcatagtctattgctgttacctacagtaacagataggtggtttgcaatgcagaacaaacaatggaaagaaatcaatttttatgttaatagtaattttaggctccagtgaaatataagtgatattagttgggctcttgctgcattggatctgatttgagattaggcccattcagactatttggtttgatattagatccagatgccttgacactggcttattttggatctggctgggaccaccgccaggtctggtagctttctcgttccctttagaaattcttcactttttgcctgcactttggattccagcttgcccatttgtctcaggctgggttgttctgctttccaggccatccccccaactgccccatacccttgaattcagacatggtcccttaatcaatgtgtaaggcagatatttccctaacctgcttctgaagccggccatcatgcttctctagttctcagataggtcagttgacatcttgcaactctcaggcccacatcacctgaaggttagaatcctcttcctatgtgcctttctgcatacaattaactctttcccaaaagcaacagcatacatccacctgttttgttcaggactctcattttccgttcattttcatagcacagatgaatgtcctgaccagaacccaaataacgatcaagctctttcccacctgagaataaatgaaccgatctatggaaagttgctagcaaagtgcctgaatgaaatcctcttccttaataacagtaattattatggctattgttattatggtatttctaactcattcatcaggcaccattcttattttcttattttccttttctttctccaggcagatgactgattttccaaatgcataatgttcagatctttaaataaacaacacatttttctccaagggtcaatctctctcagtatttgctgacctattccactctttatagcaatgaagagttgggcttaggagataaaactcaagtgggtctttagttgtttgacattgaaggcctactttgtaatcttctttttaaagacatgggaccatcatttccagaggtttcattcaattctttggcaaatgtttagtagcattgtggttatgagcaatttacataatctctttgagcctcagtttttatatctgtaaaataagggtagtgatgtcttattctgtgcatataaccaggaataaatgagatacctttgtgaaaattattaaataagcagaatgtgagataccattgtgctttggtgcattcatactgccataacaaaatagcttagattgggtaatttaaaacaatagaaatttattgctcacaattctggaggctggcaagtccaagatctaggtaccagcaaatttactgactggtgagagccctttcctcatagatggtgcgttctatggatcctcgcaaggtggaaggggcaaacattccttcaagcctttcaggagagcaggaatcccattcctgagggtggagctctcttgacttaatcactttacaaaggcttcaccttttaatactattgcattggagattaggcttcaacagaagaattttgggggggatacaaacattcagatcctagcacactgtaaggaacaattattatccagaaatattttagggggaaaatttagtgactttcagctttaaaattgaggacagaacttcaattcactaccattattttgcattttattattttctgtttctctccattttttgcctactacttcatttatacgaaaatattcttggagttttatttttaaaatagtgctactttcattatctactttgcagatgccaaataatacataatgagttgtcactcatgggctttctagtatttttaaatttagagtataaagattgatcattatgtctaagtaatgacagttttagctatcaagaaataatatgtgtacagcaagatgttaccatgtaataaacatatttttaaattttactagttgtcagtctgttttatacatctagggtctgtgagagagtaaaagaactgaaatgattctctttgcgtttatgctaccacatgtgagtgcttttttcttcattcccctttcctggagaagtcatgtatttcaaggacactgaactggtttgctgctgtcaaccctgagtaaatcttcttccaaggcttggtttccttaatagagccacgcttgcaaagttttttgtattcccaagccccatgttgctctgggagcaatcgaagtgtaggtgcagatctgggaccacatcctgctccctgtgaaagagatataggagagggaaggacagggaaaagtaaggagagaagggtaagcaagatagagacataaaatatgagcaccatgggttcatttaaaggaggggataaattaaggtcttccaagaatgactaagcatgcctcattctactcaactcctgtatccatagaaatacaaaggacaaaaaggagatctttctaggtttgtgaacccaatttcttaaaaaccacactttgaatttaaagtaggccaggatttctgtctttagtgttttccaacactcttcaagatgttgaacaaagaaaatgtcattccattaactatattagtagtagaaataagaataatgcctcacattattatggtagctctaatgtatatatcatttcagatgaaaaacctgaaagtcagaaatataaataacttgtctaagcatagtaaatggaggaacccagtgtgcttaataatcatatgctaattcaaccacaaggggatgagcttcctcaatcataatttatttcccacacatcacccggtccaggtctcatatgtaataatgtgatggtgaagggctctggaggccattctacatctaagcaggaaaacacaccaaacatggcagacagatgattgtctttattggctttccaaatggagatttctaggcaacatgtttcatgtgtttaggtgaaatgctggtataatcttgggttaaatttcttgtctaaatagcagtgccgagtgcataggaagcattcaatgactatttgaacatatgatgttgcaatcccaaaagagtcctaaaacttcaccatgaataaaatttattttcttcttaataggattgttttaaaaaaagcattttttctggagatattgtgtgtgtgtgtgtgtgtgtgtgtgtgtgtgtgtgtgtgtatctatttgcttgattcaaaaagagacaccttcacatgaacagatttaggattgatggttttggacaagttgattctcaaggggaatgtgggtcatgtaaaacaatattcctcacaacatctttttctacagtctaaatattggataccatcactcaaaagccttcggagctatatctttcctcatcagattgtggtaatataaaccaatttctaccttgtttatacctgaagtcaggcaaaagtgatgtaaagagaatatgtaagataatagcaaggctaagctgtttattttgtagctcaagtgtaaaagaggtatggtgaaagcattgtgtagacaaggcatacataatatatcattaccatggtataattacagaaagttctgctctagctttgggaacgacttctcaaaatttgatatttggagttaaatttgtgaagtgaaaaaaagcaacatgaaagggttacagagtttatatctcctcctgcacagaagtacacagagggtccaacaaatcaaaatgtagacatttgccaatgtaagtaatggatgctgtgcaagtctcagctttcatgagggtaagctgccagatggctccagtcaggctttgctaaaacacaggtgccgagtctctctgggcagttccattttcatgcctgtctttggagccaggttctttgctggcgagtgccaggcttcattccactgtccccttgatggtgaggctctgcctcaatggaggctgtatacgcaaaaagaaatttccagctttagttcccaacaatacactgacaggttgaggggagtagaggagagagaagctgctggggaacgttagttatcagcatgagttttggagaagctgctgacttcctctactcacgttagaagcaagccatggtatcagtgataaaatttgggtacctacatacacattagaagctaaaggaatatgaattctcattctaaagaaattggaagctaaaggacatgtcttcttttgaagaagtttcctttgtattatcagcttctgtcagttctcactgatctggcatttcactgggtccttgcttgggcctagataaatgtttgccagttgtttagcctaattcatttaatttagctaagcctgcaggaatattggctctttaagcagatcacttagttgtcaaaagaaataggaggcaaaacttggccagtatgataatatacatttctaaatgtctccctcttaacaaaagcaatttgggaacaatctcaacccattcatttctctttttcatttttcttagtgcaataaaaagttgcaaagaacttcaattatgggaaacaattaaaaattcagattgcaaagagaagacatcagatttgcctcaaacaggtgctggcacagatggcctgctcacaagtcctggctttatttacagcttttaaacacagacagataaattgacaaaaatgtttctcgattttataatgtgccgaatgcccaaatttggctataaacttatattaatttgtaaatgattcactttaaaccttgacctcccaagtcatcagtagccttaaaaagaccatttgtctcccctgttgtttgcatacttatgtgaatagattatctcatatttgctgttggttggatatgccttgtttactgccttgatcatttaatgatgatctttattaagtcaaattgcatgtagtctgatggctagatatttccaacctcgttgtgattccttaaaggataattatgccgtctctattttactagccttggagcatgacatttaataggaatagcaaaataaatgacatggagcccaaatgaaactatcttcaggaagaagttgatggtgttgtttcctccaggtgataaaatgtatctggagaaaccatactgtatatgtagcctgcaacattatttaatctttgctgtggtctaagatttggcataggtgcaccaaaggttaaaatgttaaaattaaaagtgagtattaaagggcaccagaaaatgaggactaacatacatccttaaattggcttatattaaggtattaatttatccctaccccagtcttatgtttctgaagggctgaaaaacagaggaaattgagatccagctctatattcatcaaggaaaatatttcagaagtgaaagtatgaaatgttgctttctccatttgtgcataagatccatagacctatctattgagtaggtcataagaaagctgcttactaatacgacaccctgccccctgtgctttacaaagctgtgtgtaacttcgctctgtgtgtgcttatgtggttcataattattaacaatcttgatcttacatcctgagattagtgtttattatgtaaatctttcttcttctgaatataatttatgttttgtgtattagaactgcagggtggatcatccattggtatttggggaactataatgattgaatgtaatttttttagactttttcattctttgtggggattcatttcatctaagggtgcagggcatgggagggagtgtgtgtctttgtaatgtgtcattgttctcctttaacccgcttgtgtgatttgctttagcatttttttcttcttaattaatgcttccatcctcatccttgctgtggctgctcatgtgtcctcctcctcctcctgtcttctgcttctgacactaaagtgcgcagcccgcttgagaactcagtgccctgcctagcaacccgcaccttggatgatgacccccgagtgcggcgcactcccagcgtgggatggctaagtaagtcaatggctggggaaagggcaaggaaggtggcggtggtcgggagagggagggcaggaagatcgggctcatggttactgagtggagggaaacctcaagaatgcctgaaagtgtaagatgtaaatattcctaaagtcgtaattgctgacttatttcttctactgtcaaagagtacagtaatgaagaacttcctgggtgatctgctgtcctgaatccaagttgaggacattgtaaggcagtggaaggattgtgagactaaggggtggggctggcactggcagccctccctccatgggacacttctctgaacctcagtttcctcatggtgatgctgaaccttcttacttcagaggactgggaggaaggtcactggagatgaggtctctgaaggtggtttgaaagcattcaagtgctaagtaagaggaagagcttactaagttaataatgttaaatacctcaaatacctactatatgccagaaagacagaatgggctatggacaacaaaaaaggggaataagatagaatctttactttttaaaaatttagagcttggtaaagtgacaagatttatgtacctaaaaccaaaagagaacatgcacaggaagctacatgcactttcccacaggtttctaaactgagtatatgtgatataatttttttaaagtagagtattaagagatgaataaggtgattccctgtccttggggggtttcctttctaatgaaggagacaggacataaatagataacaattgtataaaatgataagtgaaatgaatgaaaatacatacacacacacacgattgtgagaacatacccttggtctgggagtggcagtaatagaaagggcttttagagcaggtgttttctgagctaaatcttaaaggaaaagtatgagtttgatatatccataaaatagaaacttaataattttccttgaataataaaagttacaaatactaaatactttatgttatgctatttaattttctgaagaatcttgtgaagtggctattgttattacccacatttgacagatgaagaaattagaaaggttaagtaacttgcctagatcacacaggtcataagtgtgtagggcaggacttgagcttcatcatatggtagtttcaactataattttatgggtgatgccttactgaagttaaagtataggaaacttacatggtcagattgcccaaaagatctgctaatcccacaatgaagctctaacactcacatgattctctctgcaagaatcaagcatttcttctaataaattcttttactacttaatgatgcctcttggggaaaaaaatttcaggtaaaaagtttgggccttggagtataaagtcaggcaggaatgggtctgaatcctggatctaccactcctggcttcctgactttgggcaaattactcttttaccgtaaacctgggtgtttcaaccaactataaaactgagttaatcttaccaacataggattgttgtgagaattaaattagaaatatctaaagtatctagtgtagtgctcagcactcagttaatccagcattactgctgatagcaaagttcttatagaaattgctcaagaaattctagctgtttttatttttttaagtttcatttattccatgtcagacatccagacattgaagtatttttgtcgataaagtgtcaaggaaattgaccaaagtgttcagtttgcggatgatatggaaatatggcagctatttggaaatcaacttgagaccaaaccctggaccaatccttctgagaaacacattttagtaatgagggaggattcttctcattgtctctttatgtgatgtaatctctccctaaataatcagctttgatgtataatcaccttccctagggcttctaatacttactgtatccattcagtaaatgaaatagacacctagtgaataactaaggtgtgcaaagtagtgttaaatactgctggttttacctacctattcaacctcacttttgtctcttctcaatataaactctaatcagcttgtctcttttcttttgtcctatatcatggaaaatcctacctccatgtttttgttgataaactctacccttccaggaatgccttttttttttttttttttggtacagtcttgctctgtttcccaggctagagtgcagtggcttgatctcggcttactgcaacctctgcctcctgagttcaagcaattctcctgcctcagcctcccaagtggctgggattacaggcgcccaccaccactcccagctaatttttgtatttttagtagagacgggttttcgccatgttggccaggctggtttcgaactcctgacctcaggtgatccacccgcctcggcctcccaaagctctgggattacagatgtaagccaccacacatggcccaggaatgccttttccagtatacctatccaaaactattcagtaggacctgaatgaagttccatctcctttgtaaaatagttcttataaacacagatcttttcaagtcttaaaattccataactcctattttctgtgcctcacaatggaagatttaccatatattgtcttacgttgttctctgatgtttcattgtctttattttttcatttcaactatctacataaaaaaaagccttctctagggtctgtatctcatgcttttgtgtctcctctggtgcaggtacttgaaacaagggtgttgtacaatacacatttgttgacccttgatactccatcatttcattaaaagcaaccaacagcccagttttcactagggcccatcttggtcaccagaaaccgttaaccaaaagtgaatatggtttacttgtaaaaactatttcaccatatttctgcatatcctggtctgatgaatttgattatcaatttattctaattgttaacatggacttaaaaaactgccagaatattagctaaaaacaaatttgtaacaaggttttttaaagtttatctttaaagattttagcaagatattttcaggcctaatgtaactagaagttactaactacctttaaaagcttcatttaaagttccttttaaggagtaagctctcatcatttttacattgtgtgcttcttatcttcattgtcacctgaggcagatgtgagcctagagctcttatccatttcaaatgctgccaaggtattgaattagaatttggaacaaaaccaaaaatgatttcctcttacagatctcaccggcaggcctgaaaccagcctgggctggggaaaacaaagagaagctacttttcaggacaagttaatacccacctaaatgccttgccattattagagcataagaacataccctatcttgctagatccagaatggcttttcactcttagcgcttatctgtgaattcagtttgacatctagcagccagcatcatctgagcccttagaaaacacttgtgtccttttgcatttactggcagtcgaaatcagctgcttcagactctcaggtctgaacttcaaagaagaaaaggaggttcagagtttttttctgtcatcttatgcacattcctggcatctgccttcaccttgctttgtattttacctgtctagtttgtccatctactgggcagggacctggtccagttcagtgttttgctttgcaagtacttacccagtgtttaatgttattattatcatcccaagtattagtagttgtaatactgttttctttgttttttttttttatttaatgaaaccacagtggtataactgtagattcttgtttcatcctacaatcaggctacacagttaacattagaatttaaataactgaattgtaagtggacatttttttgcttttaaaaatttttctttgagcatttctggaattaaacaattcaaaatcttttaacttttggagagtttactgactaaattaaaattacataatttttctctggctctagggtcttcataaagttttacttctttaggaaaatggtgaacccagagaattcactttaacaagttcaattcaacagctgttcaccaagcttccactcttctagttatatggtccaatcagagggaaggagataagggaaactcacaaataacaatcatttgagagaagctatggtaagtgccaccaggagggtagggggcagactggtttgtctacagtgtgtacaacagtagcatttattatactctctgcaaatactaattagaagaatgaatggtggggtataaacagagaattgggaaaagaattcttgggagagacagacttttcaatggaccttatatatttccgtaaatagagattgtagtaagagcagggtgagacattgaaagatcatgctaggctagagaaaagtaaaaaagcaaccatgttgttgagaaagtataaataagagtttgtatgaggtagagtgagttgatacattaaattagcagaaagggcatgggaagaagatgtgtggagctagagtggcaaaataattgggccattttgtggaaggtctatgaaagtttttagtacggagatagcatggttagaactttatgttagggaaattaacctgtcagtcattctttgagtgggaatcagttaggagatgatttcagtagaccagtgctggaaaaaggatttaagctaggattgcgactgtggaagtggaaaggaggggataatgcaagaaatgttataggaatggtgttgtctagactcaataactgactgaatgttaggggaggaagagaaaggagtccaggatgcctcaggaggtagcaaccaggaagatcataggaaaccattcatgggcacaggtgctgggtttacagaagcatgacagttaagatttctgctcccatcatacgtgttgtgaccatctttgaagatatgtttcactagcagatttttaggttacccatcatgggccaagactcttctagattcctgctttgttatcacactcttagcttggtgtttttttctcctaaactttcttttgaggtggagaacaaccaccacatcacaactctctttattgcccagtgaattttgagcattcttatcttgattccaagcatctcactttccatccctctgtttttttcagatgcagacttgtttttgaatggaaatattatttgggtcacttattgtaccatttccacgtatatttttggcctttaaaatctaaagcaattccaagtacaactttaaaaattccttcactgtagcttttcatagtcacaattttcaaaagattgtaagaaataaaatctttcagcaacctgatgtctatgttcagactttttagttaacgtaagacattcagaaattgtatgtggtatgcaagaatgagttacaacattcttaagatacaggcagttctaaccactttttaataaaggaattagttactgtttatcctgaatttatgaaaaacatatcataaattatttccttgatatctaatattacatttacaatggactaaaatatattatgctgactttagacaactataaatagagaaaatcaagatgagagaataaaaacgtagaaattctgttatatttcagaatactggggacttggaggagatttcaagaggcacatatttggaaaaacgttggcagtctgctaaaattgtaaaacagttttttttttttcctaataagattttgggatttgtgaggattcagacttgtgcttgacaaaatggtgatatgtgtgatatatttataatcagactctcctgctcatcaccaaagctgtctgttttccaaaccttcctgatccttaccatctttctcccttctttcggacttggaaccttagcgtcaactttgattaatgcaactttgattatacctccagtataccactaaacctgttaaatgttacctccatattgttgcttgcctcagtctcctttccagtctgactttccttgcttttgttcatgtccttatttccttttgcttagtctgatccagtagcttgttttctggggtcagtggttatagttgggcatatggaaacgcatcttacactttgttccagttgaccttatcatacctggctgataagttacctcctcatgtggaagtgttcagtggtacctgagaggatctcaggcaacctccaaatgcttgagtctggcattcaaggcctaacccatagtgaactaaagttgattaagtagtatttcacacatctttctgtatttgcctttatctatactacatttcagcagtcacttcccattactagaatttgctggacgcttagtgcctttatcctgaatgatttttccacttggaatattcttcttcctcctgaaactttctgttaaaatcttgaccatccttcaaggcccacattctccttgaaggcttcttaacttgaggtgctctttactgaccttgaactctgatccttttctgagactcctcacatgacatttatctcattctactttgcactataatgtatgagtacatgtcttattccctttactagctatcaatttcttaagggcaggaatgtgtctgattcatttaggtatcctttattgcagggattgacaaactgtggcctatgtacaaaatccagcttgccacctggttttgtaaataaagttttgttggaataaagccatgctcattagtttatattgttgtctatatagctgctttcatgctacaatgacggagtagtggcggagatcatgtagcctacaaaacctgaaatatttactacctgtcattaaaacattttctgacccttatactgtagtcctgattctcaaagtaggaactgaagagccctaagtgtccctgagaccctttcaaagggattgaaaggtcctaggattttcatcatgtaattcaaccaaaactacatatatatacatatatacacgtatatatatatacatatacacgtatatatatacatatatacgtgtgtatatatatatacgtttgtgtatatatatatacatacacatatatacctgtatatatacacacacacacacacacacacacacacacacacacatatatatgtgtgtatatatattttttgagacggagtctcgctctgtcacccaggctggagtgcagtggcgcgatatcggctcactgcaagctctgcctctcgggttcacgccattctcctgcctcagcctcccaagtagctgggactacgggcacccgccaccatgcctggctaatttttttgttatttttagtagagacggggtttcactgtgttagccaggatggtcttgatctcctgacctcgtgatccacccgcctcagcctcccatagtgctgggattacaggcataagccactgcatctggcctcctaaaatatattttaacaggttgaacacagaagcagacaagaaaatccaattgtgtgtcatttaatcatatatatatatatatttaaaatatatatatgtttaaaatatatatacatatatttaaatgtattttattatttatttttgagttggagtctcacttactctgtcacccaggctggagtgcagtggtgcgatctgtctcactgcaacctccacttcttgggttcaagcgattctcctgcctcagtctcccaagtagctgggactacatatgtgcgccaccatgcccagctaatttttgtgtttttagtagagacggggttttgccatgttgccgaggctggtctcgaactcctggtgtcaagttatccacctgcctcagcctcccaaagtcctgggattacaggcgtgagcacctcacctggcctcatttggttgtatattaaagagatttgtaaaaatgtgaaacagtgcctttctttttatgaaattttttgtttctgaaagtatagttgtttttcataagatatacgacttatgttaacacgcaatggtttattgttaaagtgaattaatgaataaatatttaaaaatttttagttttaattcctaatgtaacacgtattgatagatatgacccaaataaacagaccctcttaatatttaattgtgtaaaggtgttctgagaccaaaaagtttgataactgctacttctttgtgtctggcagaatgccttatacatagcagtaaatcaatatatgctgaatgaatgaatgaacaatagaaccagatggttcaaatcaggaaataaatgaagtgtggtggtaataattgaaagtattgaaagggaaggttaagagtcattgagaaatgatatctactatgtgtttgtgactgtgattcctctttgttctcccagagaacattgatgagggatagtggagtaggaatggttttgttggggtgagaggaagagcaggtcttcctgactttctgtctttgctggtttcatgacaagtcatgaagaatgggctagattttgctatagtgtgagctagccccaaacatctgtgtggcctaacaacacagaagtttctttcttactcatgctactatatgtgtaatgtggatcttcaggggtctctgctcatcattgttagttaggatcaggctaatagaagccttctctcatctgtgtttccacagtcaccgtagcagtaagcaagggtcatggtgactcacaagctgcctcgtaaagttctgcacagaaataatacatcatgtttgtgtatatttcatttgacatagtgagtcatgtattgtattagtccattttcatggtgctgataaagacatacccaaaactgggaagaagaagaggtttaattagacttacagtttcatgtggctgggaacgcctcagaatcatggcgggaggtgaaaggcacttcttatatggtaagagaaaatgaggaataagcaaaagcagaaacccctgataaacccatcagatctcgtaagacttattcagtatcaggagaatagcacaggagagaccagtccccatgattcaattacctccccctgggtacctcccacaacacatgggaattctgggagatacaattcaagttgagatttgggtggggacacagccaaatcataccatgtgtccacatctcactttgaagaatgattatgctaccatgtgccctgaaggtggagattcagaaatatttggtgggcagcactaatgactaccacccagtcacaaaaggaattataacttgactttggagtgtgctcttcttggcaaggctgagagcaatgtgaagttatggaaggccactgtgcagaaaatctcctgcatactcttacaatggaggatgagggcttttcacataatgagggagggttgccagttcaaggtctactgaagaactggtgagactgtggttttacaggagacttctgaagtatactacattaatttgaaactgatagacagtctttcatgcaaatatacagtaaagcactcttattagaccaaacaatgtctggatttaatgattggagacagctcaagcgctaaatacttgaattcgtttgtctgtgcacatgtgagtgagagagacagaaggaaaagcaaatgcagtattccagctacagatatcaatttcaaagttaataatgaaatttctttttggcagcaaactgtcgaattttactttgatgaaaattgctggcaaaatcttcagaaacgaggcttttctttccatggtaagctgaatatttattgtgtttagacttgtcctggtaattcagatctcatttctactcctcttaatgcatcctccacctcaatagatcctcattcatccccttgtcaggccaaaaagtccctgtcatcttagacttcttcttgcccttcaccctctgtacccttcagtaaccatactcttctgccattttacttctgatttattcccacccttccttgactattacaactgctctaattcaggtttttatcatcatctcttgtgggaccacttgaatatcctcttgttttccacgccttcactctgacttcttaaaatccatctttcacaactgccagaaggatctacgttatgaacgccacacatcactccctctgctcaaaaacctttagtgatgactctctatcatttttaaactcaggttcatgttccctagcctggctaatacttataatgtcaagcctgagttctctagcctgtggaatgcttttgaacttggtctctgcctaacgccctaatcatctcttgccattcccactcttgtactacaagctcttgtaatttagatttctatatacttagatcccatgccttgcaatctctctatcacttattcatgctgttccaattgccccctcttgatgtgactaaatttaacctatccctaaagctcttatgtcccgcaggagacttttttcataactctcatcatctcctcctcctcccatcgcactgcacaaataactctcccttatttgtgctctcataaccccaacccccttcccccattgacttatcattatacaataatacaaatatgtttccttcatcattggcaaagtatctaaagagcttgagcagaacccattcagttttgtattcttggtgccaaacataatgtcacacgcttagacaaacattctgaacaataaggtggttccatttttgtttttgactattggacaaaacagagtttggagggaacgatgacgaatttctcaaattcatctagatttctttatttgtatgaattagttttttttttctggtggtggtgatggtgatatgtggagctgttactgggccacaaattgtgattcctcttgcatagattggggcttttttgaagaaactgatttgttcctcatccagggtctaacatagggcctgatacacagacacttcataaatatttgttgactaaatggacacttaacctgaaagggagagaaaagatgaggtaacgtaaacctagagcaggaatgatttttctaaattgatcagattttagtcttcatatcgcccaaaaaactgaccagacacagtgacatgagggaagctctgctgcttttctgtggctgctgatagtagtagaatttgagaattagattctttggttagggccttcgtttcttactgtctagatcattctatccatgactgagatatcacaaacagggcaactatgactactccagctatcatttattacaccagttcccacaaaacatttctctgaagtaagcatcactcactccttattacagatgaaggaactgaggctcagtgaagttaagtatttatggtagtcattagggctattcaccaatattccaggtctgtctctttctgggcaggtatgaggaccctacgtcttcaacccacttgaagttaggtgtgagctcatgactttctttggccaaggaaatgtgagcaggagtaatagaggtcatttcccaggaaagctttaaagagaatggctgctccatgcatctgggtcctggcctgaggacataaatgcagaaccaacccccagccaatccacaatggttattatcatgagtaagaaataaatcactggtgttttaagccatgagaatcaaagattgttctactgtaatctagcctatctgacacggagtgtttgaggtcactcagttagttggggggaacagggtttgaacttgggggtttagactccagatggcacatttccttgctattcctccctctgcttcttgttctctctactctcaggtttccttacttccagccacagatgctgctcttgtctgctcataagaagtgtagacactgatgagtcagtattttactgtttcaagtcagaaaatgaaatgcctggtgtttctcaatgaaggacaacaagtcggcattctgaagtgtaattttctgcaatggttctgttttctgagacccattcttatcaatcccaggaaacagctggagcacacttactattatgggctgtgatcagcttttgcctcagaaagagccattcactgtgatgcaagcagtaaccatggttacaaatcgaagtgcagtcttactaggtgaatgtagcagagattcagcatccttttcgaggatgaagaacaggatcaattcaactataatgacaagcttttccatctgtaaatgtcttgctttaaaaatcgattcttctagcacacatttaagctagggtcttgattttgggaattgctgtaggtttcaaggttgaattatttctccattttcctgagagcacctttgaataatttttgtctgagtttctagggaagtgtctagagcctgtaagaaagtggcacttcctcttacccagatagtggctcaggttatatttgttattattataataatgaccaagagagctgtgactgttgtcttcagtaacagtgattatcgtaacctcagattgggaagattccttctccctttagtggcgataattttatcatacccagttataggggtagagttttggggagtatactaattcattcagatcatcaattcattcattcatttaaatatttttgagtactattctttgctcactactcagctaggtgctgggaatttacaatgattaaggcagacacagtccctatcttagagagctaccagttagacctttttttttggagacacgtctcgctgtgtcacccaggctggagtgaggtggtgtgatcttggctcactagactgtttttgtttgtttgtttgtttttaaccaaggaacaagtgatgtttatgataactggactagtttactggataaagtggagcttatcctgaacaaagtgagaagtgcttgtagagagagtggttcacatctgaaggaggagaatgagaacgtagagaccgtcgaggaggtcgttaggtagtgagagatctagacatggccataggagtgttgattaaaggaactggagaaaaggcagcttagttagttcatgagagctccctcaatacaaatatttagaggaaagtagactttgggtgatcattttagtgaagaagatattttattgagactcctgatgtttttggttaaggagtgaatgtaatttttatagttcattgattttccaaaaaaaaaaaatcaatgatgtgatcgaagttttagttttcccagtttcaggctggcgaaggcctgttggtgaggatatagtcctcttatatgaggaagcagggttttttcttcaaaggacctttgtacactagttttattgggagggatgaggactgcagggaccaatgagggccttgtcatgaacattctaagctaagcctgggaacatatgaagacatacattatttctaaggtgactaatagaagctatacatatttaagtgaaaactagctttttctgagcatctgtgtacttgggttggcactctgaacacaatcctcacgctttttcttggtctgtgcaaatgctactgcttacctgggatattgaaacagtttaccacataaaaatgagctttattaaaatgaaatggatcacttcattaagtggcaggcttcctgtcactcaaagtatgtaaatggatattaggagactggctatgtataatgttataggagggaaactgcttggatgagaagttggttagatgagttccagttgccctttaactctgtgattctatgagccacatctacaacatacccagtctccagagaacccaccttgtggggtatctaaactcattgttccactgtgttgtgttcctggtccagagataatgtacaactgtgggaaagttctagtagtgctgtactgggggaatttctgaagccaaagttttgatactgattctgatatgaatttctttctcattctttgcttttctctttaccttggttcagcagaaaatggatttttttaaatgcacctttgcccactggcttaagcaatctttaactagtataactaggcccagtgaagcattcccacagctttttttgcatggtgattcatatattttaccacttgctctttttttcctaccgaattcattctccacactgctttagtagtaaatataggaaagtatatattgccttcaaatcagaatgacagatactagaatgagctaagaccatactttcctcaagagaacattagaaattaccattaaagaactttctatatccgtgatgtatatacataagtaagcgaggtacttactgcattgatttcttaagtaaataattactaatgacctatgcagtaagtgagacatctaacatttttcctagaagctcttgtattggtttgcctaaagtcatcacataccctctgtatgatgaataacaactacatttaggtctcactccttatttcttaagtcagctcaagatttcaacccccacctcaggatatgaattagaactgcaacctctcagttctctgaactcattttcttagactagaaaattacaaatggtgagtatatgggatcgcaccatggcaaatgtagtttactgtttcgtaaggatcttgagttcagagggatttatgcacatgattacagggcaaagggaaagagaggaaaactaacatctattgaacagctgagcaagacacttccacatgtgtttgcttgcttaatccttatgacatcctgataagatatttttatttccattttactaccttttcttattttgtcttttttcatgatattaataacatattggcataattctttttatatatgtctttatggatccattaggcccatccagaaaggagacgtgtgagccaccatgctgtcttctcctctactgcccccgctctgtcgccttccagtcagaaaaataatgcctgtagcaggtaatgttaggcaggtctgtgttgcagagccaaatatcttcaccaatgagacttcttagaactagataacttgatgtaatttaggagtagcacagtatcaaccaagagctgcaagcatctcagttcagcttgggcttttcaataagaaggaaatcctgtggctgtcatagctctgaacagaattttccagagtaactctaggatcacttgaggtcctgaagctatcacatcatttggaccctagatggcactttagctgaattgcgtaattaatctctccaagggggagaaaatgagtatatgagcaagtgcacaatgggacaggttgtaccctacctctcttctttctcagacttacagcactttggtctacagtgtcttcagggtcacttgggtgaaagaggcattatgggtccagaggtgtttgtgctcttcttttctggaggctactgctagagttgtgggtgtcctatagtcattgattgctaagagtgtatcacttaaatgaatgtgcagtcagcaagacctgaggagtttactgcatgaggaagccaattgaatggccttttcccaagtcatgttttgtgagctgtaaatctagagcagtgaggagggggcttgaacccaggaggttgcagtgaggccagatcacgccattgcactcaagcctgggcggcacagcaagactccgtccctcccaccaaaaaaaaaaaaaaaaaaaattacctcatttgtacacctttttccttcaaatacatttgtattattatttctaatccattattaattgcatttgtaattttaagtagtaaacctatgtctctattttttataatttgctacaaaaacctatttttgtagcaaatattgacagggtcttttgacttcttaccttgtgaaaaaaggatgtaggagcatcacacacagggacctgttggggagtagggggttaggggagggatagcattaggagaaatacctaatgtaggtgacagtttgatgggtgcagcaaaccaccatggcacgtgtatacctatgtaacaaaactgcacgttctgcacatgtaccccagaacttaaaagtataataataaaaaatttaaaaagtagaaaagaaaaactaaaaaaagaatgttagcatccctactctttgctgcccctctttttgctgcttcccttctagacttctgtcattggtgcttgtactttttattgtcaatataggttagatttatatatatatatatatatattttttttttttttttttttttttgagacagagtttcactcttgttgcccaggctggagtgcagtggcatgatctcggctcaccacaacctctgcctcccaggttcaagtgattctcctgcctcagcctcctgagtacctgggattacaggcatgcaccatccgacccggctaattttgtatttttaatagagacggggtttctccatgttgatcaggctgctctcgaactactgacctcaggcaatccgcccacctcagcctccgaaagtgctgggattataagcgtgagccatcacgcccagcctttagatttatattcttgtctcttatctataaattttgtgctttctctatcagtttgttctaatgttagaaatacatgaatagaatttatatcattatgactatatgaatatggtttaccctaaagctgtgtaatgaactgtaagtacattttcttttgggtagtttttcttaaatatggagttttagattgcattttaaaaattgcctattgttactacattcctaagctctttcaatatctcaaggatactgatacacctatggaatcccttgatatctccttgcagattcgcccctcctgttagctcctctcttccctatgttgccctcctgctttacgagactgattgctttccacatcactgcacagtggacattctggcattgactttcattgtcatcctgcgttggagaccatatatctctttttttcttagttaattccctcattttgcttatcacactgtcagtaactttgtataaaaggacaaattaaggttaaaattttttggagtttttttttttggccccagcttttctatatatatttttttcatgctcaattgatgatttggaagcatatagaattctttattgaagacaattttcttccagtcctttgaaatcatgttcccattatcttctaccattctgttttgcttaagagaattccaaaatctgtttcttgtagcttttcctttctagatagaacacttttggatttttattttcatccttagtgttattaaatttcacaatgattcatctgcatacaggaatttttaaattttttttggtttattttatttttccctgggtgtccttgtgatctgaagaaatatgtcctttatctttggactcttgaattctctttgataatgttctgggatattatattctctttgataatgttctctctacaattttccttgttctggcttagtagaactcctaataatcagatattggggttcctggacctcttatctattctcttatgttttctggctctttgccccttcttcccatgctctttggaaaattcttgttataatattttctaacagttttattgaggttttttcttttcttttttttggctgtatgtataatctcatacatataggttttaaggtaattattggtctaatctaaaatcttttccttgttctatttttcatagcagtctcttcatgttttgtggatacagtatcttcttaaatctctaaaaactaattagaacttttatttcaagttttctaagtgatatttcttttttggaattcttttgcctgcttttttctttaaggtatgggttttagtctttgacttcctctcttaaaccactgatggtgctcaattgtacatttgtacttaaaaaagaatatttgctttaatgtaagcaggaggcataattctgaggggtgctctaagctcaagaattcagaagactttgctgtgagatacaaacacctgtgctaattgccctggtcttttctggatacttcttgagcagagccctgcagtgtaaatgctttggcttctgggtattctgcccaatggggtagtgttatactttcttgaatccatccctttccttgaatccatcctttttagcctgtcccttactcctgcctccattgtacttggcagattccaatgtgagtttcttcagagttttgcagggaagatgttctcttttttaactccatgtccctctgcatggagttttacactgacatttctaaatagcataaatggtgtcatgttctactattctatctgctcttcttcttccagaaagtttttggagtctcttgtctatgctggtcttctatctgttcttttcattggtgtggctttatacttttgtaaaaagtgtttttttgtgaatctgtcatttttaaagtatctaggaaggttgaagagataaacccagttactatgtcatatactaagtttaccattttgaagtggtaccctacttcaagtatttatttatttatttttttgaaataaagtttcactcttgttgcccaggctggagtgcaatggtgtgatcttggctcaccacaacgtctgtctcctgggttcaagtgattctcctgcctcagcctcccgagtagctgggattacaggcgtgcaccaccacgcctggctaattttatatttttagtagagacggagtttctccatgttggtcaggctgggctcaaactcctgacctcaggtgatctgcccgcctcggcctccgaagcgctgggattacaagtgtgagccaccgtgcctggcctaaagtatttttaatttggatgcctcatcaaatcagagaattcttccactcatctgaatcagtaaaattttcctatgtcttggagctgatgtctacatatatatggaagagagtagaccaaacttatctaaattagacactgtatgtgtccttggaatgatgtggctgcaggaacctactgaagatcctctttaccttggcttagggacatttactgaaaatcactctgggtcagtgcctgtttggaatgaaggcagcgagatattcatttacttctgttatgttacaccgttgataggttttccctcttagcctttaactagctagcataggcttgctgaaagtactattcttttctctttctgcttttgtgagataagaaggtcacaaattattttatatggtttcatcacattttggggagggaataatattttcttcataattgttgtgtgtgtgcgtgtgtgggtatgtgtctatgtatattagtgtgctcatgtatgtgtgtgtgaatatgagacagagaaagagaactacaatcacaaatactataatcacagggaccacaggttccttgaagtacattatagggacttttttatttagtaaattttccagtctttatatgtcttttgaatgctttctcagctgagtggagattttgtatgccttattaatgtatgtgtttgtgagaaagagcatgaaatattttttaagaaatgaagctacctattatattatattcattcattcattcattcattcattcatgttggggtcttgctttgttgcccaggctggagtacagtgatgtgaccatagccaactgcaacctttaactcctgggcccaagcagtcctctccccgccccactgcctctctagtagctgggcctacaggtgtgcaccaccttgctcagctaacttttaaaaaatttttatagagatgagccctcactgtgttgctcagggtggtcttgaactcctagattcaagtgattctcctgctttggtctcccaaaatgctgggattacaggcatgagccaccatgcctggcctaacctacctattttagatcacaataaaaattatatccagtgtaatattattagaataagactctcaatgaattagagcattttgcttttgctggttgaaattggaaagaattagaagcggtgaaatttttgtatttgatattgagatgtattagacctaacactgaatcttgggaaaggcccagagagtagtcagaaaattaaaaaacaggaatgaacagggtctagggaattgaggttaaatagattatcaaagggactgtagataacaaaggtcccaaagggcagggaatggcttttaaaataagagaatagtatttatgaagcctaattgatgcaggtatctgtgatttgacctctacacactttcagctctccatataaggacatcctctctattatctttatcccatacattaggaatgacatcagcttttggcttcaactttactcacatactttgatggttatctgggtcttttgatgtcttattttctccacatttgctccactttccaagacaatcatatgcttcgacttattttagtttctcccagcttttctctaccccagcctctcctttcctttagctgagatccttacactctgccttatttctcctccatcctcacatcctcattccttctttgcagggaatttctctttttcctctttattgcttcttcttttccctctgctcaacgacaggctttgggccagtttggcagagtctttcagttctgttagttctgggccagctacaaacttcttacttatttactctaaggctgtccaagtctgaaggttcttggagtgtgcacacagcatctccctccataggaaatggactttgcacagtagtgtttatagtagtaactccaaatggaggtaaaatgataccccatcactattattcattcacaaagtattaagtgccactaatgccaaggtctgaggctataactacaatcaagacaaaccaagggccttggctctaggctcttggagtttacattatataaaataaaaacaaactttaaaaatattttaaacaaaacaaaacaattaaaaagaaaataagcaaaaatacccaaactgattttttcttagttatgaaattcctccaaagggcaccttctgactgatgatatgtttataataactttccttagtctaatatttaaaatatttttgtcttttatttagggtgtgggggatggaagtgggttggagaccataatgacatgcttattttattttattttttttcacgggatggggaagctcttaataacctgttgctgtctaaaactaggaaactggtctgacagaaatccaaactctcttttagcctttcttctagactttgtcaatcaaactcattgtaagcatcctaagtgatttgttctctttgtcccattttattcctgtttttagtgagtgaaatgggaagaaattagaactgaagtaacttgaaatatggaaaactaacatagaaataatggagaataggctgtatgtatattgtggaattttgcaaacacttgactatggctatgaatgaagacattcagaagcctgtggtgtaattcttttacaattatattgctgctgcctttagcatccttctttgccacagagctgtggtttgtgacaactatttaattagaatggcaaacagagtggctaagttcaatatttccccccttcttttctttatgaaaatgagaaagtagagtaataccatcttcatttttggaactgctaagttggaaaccaggaacataactgccttaaacctctgtagtgatgttattctgcacataattggcatgaaaatagaatatattctctgtggttgtacattacattttctctttattagccatgatgaagtttatgtgtttatgcaaataacacagagagataagtttccctctcagaggcagtgagattggcattatgagatccatgtttacattatggttttaccacttgctatgtgaccatgaacttaacctgcttgaagttcatttgtttattatcaagtggtaataataatactaacctcacagtgttgatatgaggattaagtaagataatgtgagttcaggtacctagtactcaaaaagattagttgaccattactctcgaatatagacattttctagtaggtttgttatgccaacaaaggaagaagaaagaacatcaatgagtcaatgtgggtgtagaaaacattaacatacattattctgaaatgacatttattgctagttttatggtcccaagcaatgaaaatcagacccatacctccaaatattctgacaagaacatgcagatcctcttgtatgtctattacatgtaagttatcttagttattttttgtgctacaaatgttatttattcttaagaataaaaaaagattcaatttatttcataggccatgagatctttgttttagcttgtccatgggttctctattggctcattatggaggtatgaggtgaggaggacgtttatgtgtcattgtattacattaatatgtacacattcaaatatcttctttctgtgccatagattctcctcacccctttttattgtaactaatagttataattgcaaaggactttaaattgctacatgtgtgctaaagaataacaatgattttcaaacttagtacagaatgtaattaatttttatagcaacagtatgtacctgccaagtgggtactttgaaaatgaagttgtttttgattgtgtgaaactgcttgaaaatgtgattctccaaagctttctttttcttatggccagaaaatagtgatatggaaattaattatgattatgcacttgagactggttcttcttctgcttttattttctttttttttaaatgaatcttaaaaaacacaaagtttctttggaccaagaacaagcataagacatttttacaccctggattttaggtggaaaggtcctgctggttgtagctttgagtggatgaaacaccacttgcccaagaagcaacatactttagggtacacttgtatttcacctttttggtgcaaggtgacatttttctctagcatccttacttgctcaggattgcagtataatgtgtttacattataggccaaaatctaagtagaaagcactgatttattctgacaatatgtcttctgaaatgtcagatgtaaaatattcacaagaacgttgttaggaacctgttttccaacaccttcccaggttagcaaaaatgccacacaccaatttctaattcccatgtataatctggttgataatctcttttggtcctcatctttttcttcttggatttgggtgatatgtttctggaaaaggctgattaaacagtgcgtttccaaaacaaaattatttatttggttgtataggtgaggattcagaggaaaagccagataacctctttgtgtgtttatgtggcaaggatgataagttaatgatttgcttgaggtatgatagtttagagcagtagcttggggagggcaagattattagaattatcctctggcgatacccctccaacgtatatacttctttcaacttagattccaactagtatagatactgttaagataactggtttatttagagtagtggttctcaatcttcagcatgattcagaatcccctggagggcttgttaaaatgcacattggtgtccacactccccgctcatatccagagtgttgatagaattggtcaggcgtattcaaagaagaattggtactaaatcttttgacactattccacaagatagagaaagaaggaatttcattctgtgaagccagcgtcaccctaatacccaaaccaggaaaggacataatcaaaaaagacaactacagactgaaatctttgatgaacatagatgccaaaatccttaacaaaatactagctaaccgagtccaacaacatatcaaaaagataatccaccatgatcaagtgggtttcataccagggatgcagggatggtttaacatatgtaagtcaataaatgtgatacagcatataaacagaattaaaaacaaaaaaaatcacatgatcatctcaataaatgcagaaaaagcattcaacaaaatccagcatccctttctgattaaaactctcaacaaaattggcatacaagggacgtacctcaatgtaataaaagccatctatgacaaacccacagccaacataatactaactggggaaaagttggaagcattccctccaaaacctggaacaagacaaggatgcccactttcaccacccctcttcaacataacactggaagtccctagccagagcaatcagacaagagaaataaatggcatccaaatcggtaaagaggaagtcaaactgacactgtttgctgatgatatgactgtttacattgaaaaccctgaagactcctccagaaagctcctagaactaacaaaagatttcagcaaattttctggatacaagattaatgtacacaaatcagtagctcttctgtacaccaacagcgactcaacggagaatcaaatcaagaatgcatccccttttacaatagctgcaaaaaaataaaatacttaggaatatacctaacgaaggaggcgaaagacatcaacaaggcaaactataaaacactgctgaaagaaatcatagatgacacaaacaaatggaaacatatcccatgctcatggatgggtagaatctatattgtgaaaatgacagtactgtcaaaagcaatctacaaatttaacacaaactctatcaaaataccaccataattcttcactgagttagaaaaaaaaattccaaaattcatatgggaccaaaaaaaagcctgcatagccaaagcaaggctaagtaaaaagaacatctgaaggcatcacactacctgatttcaaactatattaaaaggtcatagtcaccaaaacagcatgatactgttataaaaataggcacatagaccaatggaacagaatagagaacccagaaataaacccaaatacttacaaccaactgatctccaacaaagcaaacaaaaacataaagtggagaaaggacacccttttcaacaaatggtgctgagataatcggctagccacaggtaggagaatgaaactggatcctcatctctcactttatacaaaaatcaactcaagatggattaaggacttaaatctaagacctgcaactataaaaattatagaagataacattggaaaaacccttataaacgttggcttaagcaaggatttcatgacgaagaatccaaaagcaaatacaatagaaacaaagataaatagttggaacttaattaaagagcttttgcatagcaaaagaaacagcaaagtaaacagacaacccacagagtgggagaaactctccacattctacacatctgacagaggactaatatccaggatctacaacaaactcaaacaaattagtaaggaaaaaaaaatcccatcaaaaagtgggctaaggatatgaatagacggttctcaaaagaagatatgcaaatggcccaacaaacatgaaaaaaatgcccaacatcaggaatgatcagggaaatgcaaataaaagccacaatgcaaaaccaccttactcctgcaagaatggccataatcaaaaaatcaaaaaacagtaaatgttggtgtggatggcggtgatcagggaacacttctacactgctgaggggaatgtaaactagtacagctgctatggaaaactggaaaacagtgtagaaattccttaaagaactaaaagtagaactactatagcagcacaattcacaattgcagaattgaggaaccaactcgaatgcccatcagtcgacgagtggataaagaaactgtggtatatttataggatggaatactactcagccataaaaagaatgaattaatggcatttgcagtgacctggatgggattggagaccgttattctaagtgaagtaactcagaaatggaaaaccaaacatcgtatgttctcactgatatgtgagagctaagctatgaggacgcaaaggcataagaatggtacaatggactttgggaacttgaggggaagtgtgggagggggtgagggattaaagacaacaaatatggtgcagtatatattgcttgggtgatgagtgcatcaaaatctcacaaatcatcactacagaacttacgtagccaaataccacctgtatcccagtaatttatgggaaaaacaaaataaaataaagaattgctctggtgtgagtgtcaataatctgcctttctaacaagcgtacaggtgatgtggatattgctggtctggagacctcactgtagaaaccactgatttagaggattgggaaggatttgtctctgcttcaaggtcttgggaagtcaggatggggagtttggtagggagggggatggaaaaagattgaagaatgctgatcatcttgcttagttactagaagtgttgactagcagactcttgcagtgttaaacattagtgaagctgttaatattaattacttttattaatgagaatcagagaaagttaggagaggaaacagatttgattatttcttaatactagtcttctcttcctcatctggttcctgcatttttcttggacctgaacctttctcttgctcctcatatagtataaatatagatagccatactatcactgtctttcagaaatgcgaagaatgatgagacggtatataaggtttcttggaaaagctgtcacatcaatcaagattacaattataatgaaaacctcattaatttggcttctacctattcagattttgcagcagttaggacagtgcttgggctgaaatgtgcctttgcagtatttataaagagtgcctatagcaaatcaatgactttaggctattggctaggaaatttaaattacttaatggaaaactgctttaaatttatttcagtactgccacttacatataaattatttgatgattagaaatttatcttacctatttatttacataagctattttcaacatgattaggattgctaaggcttcattgctttaggattgtataattcagatttattcacttattcaggcagaacttttactcagttagtccaaatagctggttttgtttttaaatgtcaagtgcaaaattgtctgtactcatcattttctattagtttcaatctcagcattatttgggggcattcagattgtacctagtgtcttttgtattgagtggacactagaaatctaatacctggctcaaagaagaaaatgtgcccttcaaaggggttcttttaattttgcacataaagcacattttcaaatgttattttcctttgaataatgctctgtgcttaaattttcctagaataaaacacccaaccaggtaaaagatttaagagatctaggccatgcttacttgatgaaatgcagcagagtggaaaatatcctgtcttgccagttcaaggaaattataatttttctgatctggtagttaaaaggaatgatatttaaatagctgctgttatataggcattaatttattaggggcagattttagtcttttgtgaaattatatgttgaggtctgtatctgaaggaattaaagtctaatctaaagaattatttggaagcaaatgtgaagctatgttagaacttcggtgcttcttttcaacccttgtcctcttgctgtaaagagcagcctgagtcagatcattgaggattaaggatgaatgcattactcagcaccctgcagcagttgggtcaaacatcttggctttgaaaagttaggtttttttttgcttagcaagcctagaaatttcaggtccaactgcagaatgaaagttcagtattctgttgattaacatggtctacttgaaaacagcctgtggctcttctacatgtccttcctctctatttgtgtatgatagtgtctgaaatcattggatggatcaccggtgaaccatattgacagctgctatatggtcagggagattggttcccatgtagtattccgatgacatccatcctttcacttgaagaagaggtttaacatgttaagggggaaaagaggatatacttattttattctggcaaatgggaatgcagagaaataaggcagcctgtgataacactacattgaggcaaagagtgaggattctacatcagatgcccactaatgagaaatattcttgatccaagtgttagccagagaagggaacactttgaccaagacttttcaggttgatctgagtgagtggcatgctaggaagggctgcaaaggcctgggggagaggaggtctgggcctggcatccagggtcagctctgctgaagatgaggaaacagccgctctctgcaggcaacaggaaaaggaaaggaaaccagatagattagcatgtatgtaaagggcaatgacaaagagtgaacaaaaccaggaacaattttatttttatgcttattgtcttagaagtttctttcaaagtttagcttaccttgaaactgaaccaggcagtaagtcctaaacaaggtatttgagattttacatactttacatttaactatgtttgtactccaacctggactctggaaaactcttcagaagaatcctagtgtggttaaaagtatcatcaccatttccatcatcatctactaatgtttattaagtataccaccaaagtctttgtgttattgaaaagaagtctttaattagagtttacttgtgtttttccaggtagcccagccatgacccataggaatctgacttcctccagtctgaatgacatttctgataaaccggagaaggaccaggtaagcaaaaaattcttgcttctttgaaatgtaagagaacgtatatctaaaagatgctgagaaaggattagaggtgatggttgcttcacttaaaatggacctttacgtgcagacaacagtttgcactttcctgggcagaaggagaagcagtgtgtgaagggagctggaatcagaagggaaaaatgtgcgtttacttcagctgttgcagatgcatcacttgggcaatttaaatcttaaagcaatagttgtctcagctttaaaatagtaataatccctgccttctgtttattctagggattaaacgagataacttatgaaaaaaatactttggtaaattataaagaaatacttgcctggcacagtggctcatgcctgtaatcacagcactttgggaggctgaggtgggcggatcacttgaggccaggagttgaagaccagtctggccaacatgacaaaacccgtctctactaaaaccacaaaaattagccaggcacggtggcacagggctgtaatcccagctactccacaggctgaagcatgagaatcgcttgaacccgagaggcagaggttgcattgcactgagatcgcaccactgtgctccaacctcagtgacagagcgagactttgtctcaaaaaaaaaaaaaaaaaagaaatgctaagaaatgctgaaattgttgttaacttttgggggatactttagggcaaggtaatgacagctaagttctcactagctatatatttgtttgtctattaaaacatatagttgaatgaagagcaatcaggttttgaatatctgtttgctttctttggaagagaatatggtgtaaactgggccatttttgcccagctacgtaaatatctctgcaagaaaattatattttaagaatatagtatatggaaaaatgatgcttcctaaatgaaaaaatttcaaagttttgaagaaatgaaagcaatatatttaaaaaaatcatagaaatcctaagactgtttccccaggattgaaggagaagtagcatatattggaaagaagaaggaacatgaagcaagaaaatctggtcttgctacttgttccaaaactggctagttgtgtgatgatggacactagttttgttctttgctaagtggaaactataatacataactcacctcagaaaatcaaatatctgatccttgctcttttaacttaccattttgtcttttgatatagtagaagagatggttctggttggctccatgcttgatatgctaattgtacagttagtcctccatatccgtggtttcatatccatggattcaaccaaccatggacagaatgaaaataaaattgtgtctgtgctgaacacatacagactttttttttgttgtcattattctctaaataatacatcatagcaactgtttacatagcatttatattaggtattataagtaatctagagcaatttaaagtgtatatgaggatgtgtgtaggttatatacaaatagtatgccatttatatcagagtctttagcattgtccaattttgttatctgatggaggttgtggaatcaatccccaacatatactgagggatgacttgttctttctctttctgtcttttaagtgggtgagtttgaagattcttcttttcacactttgctgatttttttcaagaagccatattcatgatggtgttcctctttaactgacagcacttgtagtagtcatagaggtttataggccttggtgaattctagaaagtacgggaagggtgtacattccattccattctcccgtcccttcccctccccttccgtcccctcccctccgttcccctcccctcccctccccctctccctccctcccttccttccttccttccttcctccctggtagtgtcttcatcatctcagatctgaattgctagaaaagctgttggaattgatcccttgtccccattttttctcaattcaatatactttttacatagttgccctcatttttctactctagattaaaaatggttagtggcttcccatcattttaagttcaggacttcttgatgacctttatgatgctctgaaatctgatgttatccgtcttgtcttcatttattcatttgtgttccccagaagagggactctgtttaggtcaggactaatttctttacttacctcccactttacattgagataaattcttgactccttcagttgctccttcagatgctaatgtggattgtcaccttcctttcatctttctacctcttgaaatgatcaggaagaagagcatttaaatatgggtacattggtagatacatacctgtagtggaaaagggagaactcaggccactagaagttttcttaaatttatttcgcacattttgtctccactcattgcttaccaagccatgctgattatttgcaaggtttgccatgagtcttaatactggttaaggcagtgtactaattagcttaggaatatcttgttgatggagttcttgaggaagccttcttttattaagggcagctctccttttgccaggaatttggcaagaagcagctggtaaatgctgacagataaatttactaacttattgggtcttttcatatctgggcatatgcagaagaaatctgatggcttaagatgcatattacataaaattttgattccagtagtagaagaaatatgtggaacattttttgtgggtattgattttgttataaagcccatgggaatggagtctttaaaaccagaatcttcagtgcctatcactagcatctcatagtcatcaaggttcatgtttagatgaagcgaggaaaatttaattcaggaatgttccttttgttttcaaagccagcaaaggaaggttgatgaatatataattataagaccaactattaatctaatttgtatctattacagtgtatatagttaatccaatgagttcttcaagaaaggaagaaactccattctctcttcctaccagagtttgaagagaggcttttgtaactaattcataatctcttctacaaccaaaggtacaggtacagaaatcaaactaacattttcagtttctatacctactattttggtaacttcaaatacaaaaactcctggatcattttagggcaagaaaaaggaaagtggatttgcaagtaagatgaagctgtgataaactctggcttttatttttttttaacctgtttcttctctgtttggacaggaaagaaaaaaaaaggtttccaggcttatgtttgttttgagaaagcttttataattaattagccagtgtcctggaagtgatcttggcagtaaactcaaacttgtcttgtgtacttgtccaagttggccccaaaaacttccatttgaccaggactgaaatttctgattgactgattattctgcctggatacaatttgaacagttgtgatggtgccttgcaacttcctggagctacctaacttcttagtagcacaaagaatgggttcagagttatgaagaggaacagaattgctctttctgacagctacatagtgacagaatttgagggcatattttttatgagattctgttttgggaaaacagaagaaacaaatctgtgggctgcactttttctttctggctttgccaagcctatgtgcttacgatttcagtagcggctgctttattgaaaaatggcttaaaatagttaacagcagaagaagagcatagccagaatttaggtgattcaatgcttcaaccatattccaacttggatgttatatttattaagcagaaaaacacctgtggagaagtagatttaaaaaatacatctggagttcatctagttgtaaatctacataaataatctcttctattttgttgctatggagtatttttcacattatctaattatgtttcttgattgcctttgatttgcttttccatttcttcttattctttttctgttcttttaaaaatttacatgtgaggtgggtgcttatcaaatgcagtggatttagttacagttttcatgtgaatatggcttcagctatgaggataagaaagagcttttctcttcattttaccccttagctttaactcttgtagaaatactgtgcttagtggtgcaatggctttaaaaatgttgactttttccaggtttattaataatgctataacatctcacaattacatgtcaacctcaagtgaaattgtagtctgtagattgcagtggatgcagtagatgtagaaatagcctgcagattctcagggggacacttgaggtctacataaccttgtaactgcttatctggttattatttctgtgatattcattatttagctggctaatctgagaatctattccataggtcttgtggtggagttttgcctaaggttactttctaaagcatattagaatcatttttagcactgtctgttgcctattatgtttaaatatattttgctgccttgattcttgtgtttgaagtcttggtcttttaaggaaatagacctgaatttaaatattttgtcagaaagtatgcggatgaaaccattaaccatgtataagtttaaagttgctaagccataactatcttaaaatgaaatctagaaggaaacatcctgtgattattgggggaataacccccaatccttttcttacacatacatgatataggagtgagtcaaccaagtccactgagatgactttttctcatgattttgaacatagatttccatcccagggctcacataaagcttctcttagcattaatagttatttcatgctcacagtgaaggaaaagtacaaaagcacctccttttcctttccatggctcagtcaaaaaaacctacagttcacactgaatgtgggtggtcttacttcacccctcagaggaggtacagtgtctaagaaagattcatattttctgaggttataataattgtctttagcatgttttcagggagcagtgagacattgctgtgttagaggagctccagatggaatcacatctgtgaaaacctaagaacaaaggcatgttgtgagaaggtagttagggtacttagaggtccttagtcactacagttttggtgactttggtgagcatctctctggctcagcacctacagctttccttcagccaggtgtccctgaggggaacttgtgtagccatgcaatgatatccttgggcccctttcacagggaaacagcttgtgcttagataattaacaaaacatgtctgtcattattttttccctgtctacaagaaatttggcttaagatagcttccttttcccattctatgcttctcccatattcttaaagcttaaacagttgacagggattagtagggtttgagaagcattgatattaatactgatttaaagaaggtatgtattttaaaattgggacagttgcatctccgcatttattaatgttgtacattcttaaaagctatttgtctggaatagaaaactagcattcatttaagaacgggttttgtatcagctttaaactgaagtagatgatcctgtatgaagtaaactgaactctatctcgtgtattattttaggaaaaaaggagccttttgtgaaatttagagctatggttttaagtaactgcgctacaataaatttgaactcctaaaacaccccatcactgcatgcagctatgatttgaattcattcattcaaaatgtatattctgtgctagaaaatgttcttagttgtgggttccagaagtgaatgaaacagataaatcttttgactcatggaacttccatacttttgggaagagacagactgtaatcaagaaaaacaataaatacataggataatttcacataatcaaaagtgctatcttgaaaataaagcagggtaatgtggagaggtacaggaaaactattttaggtaagagggttagccagtaaggagaggatctggtgagagaggtttctaggctgagcaaaaagcaagagtagaggcctaaggcagaaatgaagatgatgtgttcaagaaacaggaaaaaaaatatcataagtggctggagcaaatgtagcaggtgtgcagtggtagacaagtcaggaaaataggccggaggaccttttattttattctgagtgcggtgagacactctcttaggatttttacctagagtttgtatgttctgatttacattttaaaaagctcactggagatgcaatgtgataggatggagaaatttgtgaatgtgttggatcgtctggtgttattcctatattaagtattgtatgaatatcccagtgcattaaaatgagagctcacagacccataagagcccatttcttaatgtgttagccatagccattaagaccttattactatcagcaaaggaagttcttctgtgccatagaaatatcgtaagaaagaaaaagagtttcccagttaaaaggtcatccatgtactgttaattatattacattattaatgagtaaatattaattattgaaatatttaatgcactagaagtgggtgtaagccaccaagaatagtgagattgaatttttgagtaattatatttgcacctgtggtcctcttgttattactgttggctaacatgaggcatgccaactggctaatgacacatgattcatgaaagcttcactggagtcctctctgaagaatggtaacaggaaaccttcttagtctttgtggttcagaaaggagcatcaggatgtgtaggaacaggacagaacagccaaaaaggggctctgtgccacattcttacctgttcctatgaaagaattgaactccgattgcactgcatccctgtattcaacatttaaccaaagaaattgtagctattgcatatcttaataaactggcatgttttacatttgatgtcactttttttctcttttcaatatgtagcattctgccagtatgccaataccaggaatatacctagaatatatttcagagaacagtagcatgctgtcaacaataatctttgatggacgtatactctcacatcacaagttacttacatctgacagagacttcataaaagaaacgagcatttttcttcttggaagtggcaaattgttacaaaaccagaaaacagcaataccttgtgatgaacactcttgagtacagtttttaaaactttatagaaattgtaaatatatatagggaatcattctttttttttctttttgagacagagtctcactctgttacccaggctggagtacagtggcacaatcttggctcactgcagcctccaccttttgggcttaagctattctcttaccttagcctcctgaatagtggggactacaggtgcacaccaccatacccagctaattttttttttgtgtatatatatataatttttttttgagacatgcagttttgccatgttgcccaggctggtctcgaattcctgggctcaagcgatctgcctgtcttgaccttccaaagtgctgggattataagcgtaagccactatgccccacccatggaatcattctttacttactatagtaacatgttattatccacaatattttttaaaactttagaattttctgattcaaaatatacaacaatgctgtaaaatttaaacaaagcaaaaatgaataaaataaaaagtgaaaattcttaaattaaaatccttcaaaacaactgccattagcagcttgatgttgagtttaatgaacttttctgatagatgaatacttatatatttctatataaataataaaaatgtgattgtattgttctaaaatttgatttttttaaactaacaataccatggacacctaccttattcttcttaaaggctatatagtatatatgaatcgtattttattgattctatcttctatgactagatattttcagttctttgctgtacaaataagcctttaagaagtatccttattgtaatttttctgcattctttcatgagtatttctggaggagaaatttttataagtggaattgctggattaccgtgtattgcgaatttaattaccttcccaaaagattatatgagttatgttctagatctttaaacactttattgaatccgcctccactgctaagatactatttgctggtcagatttgagtttattctttatgtttcactccactaaaagcttagtgattcaaaatgaaaagaatctcagtatctagcatttgcctcccagctcactttgggggctttttgtcagaagcttaaagtatagagattaaaactgagtttattttcctgatctaattggacgtccgagctggctaatcacttgtattctgaagtaaggaggtgaaaagtgcagtggccatatacttgctttgactgaagatgttgctgttcccagctctgagagggcttttcaggctctgtgagaatttccttggcaaccaaaaaatggcttcatctcaagagcccttcttggtggtcagcatttggaacaaaaagaaaaattgcaaaaagagttggacaagtgttccctttgaatattattcaacacatttgcagcttggatctacatctccttcctttccttcccccaacccccaagagaattttaaatgcatatatgccagactgtaaagttagttaaataaaaagttttataccttatatggagtgctttattaggagctttgaaggagtgttgtcaactgaaatggctaataaaaagatgagccaacacttttttttttaacatgttggggcatatttgcagattctactgctccccaatttccctcttaatagggaatctctgcagagtaagtttatgaagaggtcacaccatgggaggaagtttttcctgttcttctttagaaagagaagagctccccactgtttctagctcacttgtctgattgatccagtggctggttgatttatgtgtctcagcagaatctcatgaccttatcagtcaccagcagagcttcctggtttctccatgtgttacccaccaatgggctggttttacttcctagaactgaactgaaatgaaaacaatgattcttttttttttttttttgccaccatgttaaaaggacagcagtaatgttttctacaatctgaaagccagtggttaatcatgccaagatgacattcctgactaatcagtgttccatgcatacacatataagagggtaggaagtaactgagtcattgcatagggagtgattgtaagctttgaacttcaaaattagctgtactcttcatcattcagtagctgtatctgatagtattgagtctattgctacgtaagcaataattaacaactagcatagattggacatctaattacaactaatgctttggggttggtactgtcaactctatttgacatattggcaaactggaggcatgaggagattaagtaatttccctaaagttaaatagcatctaaatgatagagctgcatcctggtcctagtgcctgtgctcttagtggatataatgagttctgcctagttggattagggtctttttaggtccctgaaagccactgtggaacagacacgtattcaatcgaagtttctggcttttggtttgtctttgaggcaaacatcatgctgaataggctaattaccagaattactattaaaaatgaataataaaaaatttttaagggtcttatggtgactggatggatgtttctgctgccacaatgattaaaatactcaatgttatgtgctgatactctggatgtcattggtgaaggtcagtgaaaaaagactgatataataaaaaagtataatctatgatctcagattgtgagtttatatcttagctgattattcacaccgaataaactgtggtgctgacagtgaagtgcagctggggttcagtgaaagacacaactgtgtgggccaaagccatcaatcaaagaggaaccagggactttagaagcatctttccattctagagaacaaaaataacagaataaaagagttttaaccaaataaaacattcttccttggataaaaggttaggtaagaaatgggagaaataaattggaatgcaactatctagagtttagcaatacaagtaaaagacttagttcatctaataaatggaaattattgtggcttttagaattatttgaaataatagccaaactttccaaatttgaggaaatacaacatttcaatgttttttttttttgtagttagtgtgacatgtagaattagtgaaagtagattagttagttgacttgtccacagaccacaatgaatagagagttacaacacacttaatttacagatcttcacttgtgctttgctaaaccccatggttctttgactttcaggctgttaaatattcattctcactatagatagggtcaactctagttcatttagtctgataaatgcacatcattatgaccttaaaattttgttctggtaagaggaaaaagtgattattattgaacttttttattaataagctaagatataaacttacaatctgagatcatagattatacttttttattatatcagtcttttttcactgaccttcaccaatgacatccagagtatcagcacataacattgagtattttaatcactgtggcaggagaaacatccatccaggatcataggaatagctttgaagacttaagtaagcatagtaaaccttaactcttctgaacttcagttttctgattcataatagagatattatacttcagtctgaactgctttttctactgagttgttttgtgaaaaggaaaatacttaatacacttcaaaatgttatataaatcttcatcatcattgccattttcattatttaaatgggctactgcttttttatttttggttttgctttgcagtaagatttggtgggatgaaagtccatttcatttaggtatcattccttatcttttaaatttgcattgttaatttggctctttggagttcatgctcttaacttctgctctatactgctctatccacactgtaaagaaatgtatgtccgattgtcatttcatgaatcttattgaatgcacattactcttgtacccaaatttctctttttctctctacttttccaagtcttacctttacttcaaaacttgtcaagtgttactttttctttatatccatccttgaatattccagcttatgttaactactcctgttttgaatttccaataccatctagtacttattattttcatcactgatgtggtttggctgtgtccccacccaaatctcaacttgaattgtatctcccagaattcccacatgttatgggagtgacccaggggcaggtaattgaatcatgggggccagtttttccttttctattctcatgatagtgaataagtctcatgagatctatgggcttatctggtgtttctgcttttgcttcttgctcattttcttttgccaccaccatgtaagaagtgcctttcacctccctccatgattctgggcctcccaggcatgtggaactgtaagttcaattaaatctcattttcttcctagtcttgggtatgtctttatcagcagcatgaaaactaactaatatagtaaactggtaccagaagtggggtgttgctgaaaaaatacccaaaaatgtggaagcaactttggaactgggtaacaggcagaggctggaacagtttggaggtctcagaagaagataggaaaatgtgggaaagtgtggaacctctagagacttgttgaatggcattgacaaaaatgctgatactgatatgaacaataaggttcaggctgaggtggtctcagatggagatgtgtaacttgttgggaactggaacaaaggtgactcttgttatgttttagcaaagagactggaggcattctgcccctgccctagagatacgtgaaactttgaacttgagagaggtgatttaaggtatctggcagaagaaatttctaagcagcaaagcattcaaaaggtgacttgggtgctgttaaaagcattctgttttagaagggaaacagagcataaaagttccgaaaatttgcagcctgacaatgcagtagaaaagaaaaacccatgttttgaggagaaattcaagccagctgcagaactttgcatgagtagcaaggagcctaatgttattccccaagaccatgggaaaatgtcttcaggccatgtcagagaccttcatgaaagcccctcccatcacaggcccagaggcccagtaggaaaaagtggtttcgtgggccacacccggggtccccgtgctgtatgcagcctagggatttggtgccctgtgtcccagatgctccagctgtggctgaaaggggccaatgtagagctcaggctgtggcttcagagggtggaagcctcaagccttggcagcttccacatggtgttgagcctgcgagcgcacagaagtcaagaattgaggtttgggaacctctgcctagatttcagaagatgtatggaaatgcctggatgcccaggcaaaagtttgctgcaggggtggggcccttatggagaacctctgttaggtcagtgcagaagggaaatgaggggttggatcccccacactgagtccctactgaagcactgcctaccatagctgtgagaagagggctactgtcctccagaccccagaatggtagatccactcacagcttgcactgtgtgcctggaaaagctgaagacactcaatgccagcccatgaaggcagccaggagggagaatgtactctgcaaagccacaggggtggagctgcccaagaccatgggaagccaccttttgcatcagtgtgaaaactggagtcagaggagatcattttggagctttaaaatttgacacccccactggattttggacttgcattgaccctgtaacccctttgttttggccaatttctcccatttggaacagctgtatttacccaatacctgtactcccattgtatctaggaagtaactagcttgcttttgattttacaggctcacaggcaaaagggacttgccttgtctcaggtgagactttggactgtggacttttgggttaatgctgaaatgagttaagactttgagggactgttgggaatacattttcaatttttggagaagttcaagagagaggcagttgtaaaatagaatactagtgtggtttttttggtttttgtttttgttttggaataaatctgaatttagaatgattccacattaattagttccacaggagtatatacaggcaaattttatattggtggtattctctttcccctctcctttcttgaaaataacaagccactagccagcctgtggtagtgcattaatcattatttttacattgatacaaactattgtgattttttaagctgagaccatagaaagctgacaaagcactgtgggcatatatagcaaatgtaagacaggtttttgtgctgaaagagtgtacagaaagtgtcactcgtggcttataaccattcgatgactacctgttgcctttatgataaagcccagaatccttggcatgaccttccaagacctgcgttatcctgcctggtgtctctctccaaagcagatgtgccaggttttctcccgtcctgactttactacaaccatatggtattcttccagtttcactaacatggcagtctccctcctacctttgggtctttggacatgctgcttttgttcactgaaatgtgcttccttgtccaggcaactggtgttcgcccattatttctctgtaaatgtcaccttttcagggaagttttctgtgacacgccccccccctcttgcccccagtctttgctaggggctgctgttataagctgttacagcacatgatgcttttctaccatgacacctaccacaactgtcatcaaatagttgcctattttaatttttggctacatgtttatcttcactaataggccatttgcttcaaaattggagaaatgatatccagccatctgtagttcatggaccatagcctgccagtaacttgcttttgtatggcttgcaagctcagcaaggttacagttttaaaaagcagttaaaaaaaaagaataagtgacagatactgtatgtttgctcataaagcctaaagtatttagtgtttggtctttcacagaaaaagtttgcctgtctgtggtctaagttgttgctatacatgttgggtagaagaatgtaagtgtatttatatgctacgttttattttctgagcagggcacttcattgtaatgtggcatctatagggcctagtgatgttgctgtaagcacttagacaaactgagggccgcatgaacatcagaaggttcttagctggataaacaactgtactcgaagtgtgtcaattaatagccagtgtaaaagtggaagaggtttctaatgccatggtactttttagcatgtattgctctgctaaacaactgtattagcaatttagattaagacataatacgttattatcagatttacaaatacacaaaactgccatctaaaatttaagtaatataattaagatggagaatgatcttgacaggcttcaaaccacaggaatttcacaagagtaagataaactatgtaagatctaaatgtggagtgaataagaacgtgaaaaatcctactttatttgaacagagaatttatgactttcagcagatttagactcttcaaaggtgtccattattcagaaatacttgaggagatgtagttatggtaacagtgtagtgagatgcctgggcactaacctaagaagaaaaatagaagtaactcatccaaaacttttagagatgagaaagcttgaagggtacaaggctcatgaaagttgccttccagtgagagagaatagatttattgttttttgctccagatataaaattgcaatagcagatggatgtttcgtggaagcagatttcatttcaatataaggatgaattatataggaaattgagctttgtcactaatgtatatatgaactttttaaagtctttctttgcacttaaataatacagtaggtatcaggactacagaaagaaacagcaaacaatccctgctctccaggaggtctcattatagactgtgagatgaatcggtaaataatgtaggatgttagatgtcctagcacagaaatggagtatgaattttgtcaggaactggggagtgggcagaggtgactctgaattaactcttgagttgatgctccttctttcactataatgtaccagaagaagcaaatgactgtatgttaggaatgtgttcactgggtggggtattataaactagtcaatctttaagtaatttaaagactttgtgatttataggaattcaaaaataagaagccgactttgggcttgaccttagaacaaaggagtgaagggatctcaggtcaatatgtcagttaagtaaccataacctactggtggctcagccagaagcccccagatgcagatgaagaacccctcaaccaaacttctgtatagttgttgcctgcctttgtgtcagtgtcttattttcctcttgattccttttttctgcttcttcagtattctttattgttctaatttggtacatgttctgagacctccgtgaagggtacattaaaaaatctgctaaataaataatagcatgactactacagatttaattatagctatacagctgcctgtttgaagtgttctgctggggccatatgttcccttgtatatctcagccctggaaagacctagtttaattgtttcccagcttatagtattgaattcttaaagaactgctagcagtcatttggaagtcaatagattgtgtgttttacctcaactgtctttctgcaactggatgttttattgacaatttcttattagatcccaaataatcagatattaaagcactcatccagacaggtcttaagagctatgtctacttgttagttttacagtctgatttttgtcatcatatttgatgtgctaagtgaaaagtacttctgcatttaagcactttccctcaatggcttttttgaaaaaaagaaaagtattttagtggatgattcttttaatggttttctgtccccatggtatggtgggagcagaaatggaggaggacttgggaaagggcgcttgttgctgttctagaagtataaccttgaacatgtattaacttctctggtcctcaggagggccaaaactgagcccttctaggttccttccagttctaaaattctgtgattcagatcagctggggaacatgctcttgccagtgaaatgcatctggagaagggtggttgttccttttcccactgtggtggtctgtgcatctcttcccccttgtgcttaggaagcccaaatttcccatttcttgagccacaaaaatctttcaatatgaactctgtttagagatcaaagcctcacagagtaacagagctgtggccattcttatctgctttttcagtgcaaagatggtctaatgcagtggttcttaagcttttctcatgtcaaggatccatttgagcttatgatgaaactgtggatgctttcaccagaaaaatgcacaataaatatgaaggacaaaaagttgtgtgtaatttccaggtgcccatgcactccctggatccccatcagccaaccttaagaaccattgctctgtgctttgataagagccctgacatctctgttttgttctgagtgaagggacctgcaggtgaggttgagaacagtgaagtagagggcctaaggcctgaagcaccagccctgagctttgaatggtgccaagggcagagctttgttgggttcataaactatactagggtggagcaaagggtgggagaagcaatggaaagtgttttttccagtttctgcacaagataggcattctgcataagtgtttgtcaatccattaacttttatttatttattattttcaaactattaacttttaactcttggttgcctacattacctctggttattctacccttttaccatgcatgccttgaactttttaagagagaagtctatgttttttattagttaccccaactggggtatgtgcagaagagaatgcatgtaaaacaattctcctgaaactatattttttatttttcttgaagtcagtagccccacaatgttttttcatttgtctatttattttgatttcatatggttgttccttccataacctttctttcctaatggcagctggagtttgtggggcagaaagaataaaagaaatcctatgtttagcatctcttttttgggggtaggagagggaagactattaatagatactgctttttagataataataggtaaggccaaagttagaaataaagcatttcattttaaaacaaagtgtttctgctgaacatagtcattcaaggataagggtgtcattctgagggaatgcagatcattaagattggtgcagttatcatgaggaattatattatatttgttttacagtgtagttgcactgaaccacccatgctcacctcagtctgcagttcattttgcagccttagcatgagatgctgtctcttcaaccttctcaagctaaaatgcatgcaactatacacttggtagaatgaacttacctagggaggtactttactttatggataacatgtttttaagtctatgatacaaactggtggaagaaatttctttttaaagttcagatgattgtatatctgaattaaatgtggtggcaatctagctgtattttactttattcccttgggaaagagaaattttatttttgtcagtcacctcttccccttttttctaggattatattagaactctaatgtgattataattattggtaccatttattgactatctactatactatttcaggtactgtgctaggagcttttacctatatcatgttgtatattatcattaaccttactttacagatgagtaggctaaatgtagatgataactttgtagtcttctcagcttaactgttgcgtaggttaaactttaaaaaatttaaggcacagatatttttaatgcacagctgaattttaaatgatgtatctgtgaatcaccagtattggtgaaatatttgcttttaatgttggagagcactaagcatttgaagaaatcaaattctcgtgttgtgtgtcatgctggattcttcctgctctgtcaccccctttatccaggcatttaatgagtcttatacattctgccttttaatttttctcaaatctgtcttcaacattcagtcccactgatgctttcttgattcagggccccatagtgttcctccatttaacatatttattgagggacctattatctgctcagcattgtgcataaatactttcaaagatcacctcatttactcttcttaattccacagagtaatcatttattattcccattatacagatgaggaaactcactttaaagaaatgaagtcatttgtccagcgtccctcagctaataaatggaagaactgagattttcttctagctctgtctaattccaaagcttattcctgttttcactacttgaatttcaaacactggataacaattagcaagcttagcatggtgaagcttggactctggagacagccagcctttggtttgaatcttcgttctgccttttctagttttgtgatgttagctatatatagcagtttcccatcacctgagtgaggtatgttccaaaacccccagtggatgtctaaaactgtggacagtaccaaaccttacatatactgtgatttttcatatactgtgataaaagtttagtttacaaatcaggaacagtaagagattgacaacaataattactaataaaacaattacgacaatattgtataataaaagttatgtgaatgtgctcctactcttgctctctcacaaaacatcttattgtactgagttcacttattttcagaccctgcttgaccataagtaactgaaactgcagaagcaaaaccttagataagggggaatttctaaatctcaatttcttattgggcaaatggagaccacaataataacttacttatagaaatgtggtgagaatttaataagatgatgcatacgaagtttttggtccagtgcctggccagagatgattgatttaaaacattttaaattattattattattattattactagtaattttagaattattattgaagctctttgtgcctgttggtaacaatggtgcctttagaattcagtcttaccaatatgagattcaaaatcttaaatctggaaggaattcagtgtacagctgttctcccaaagaaagactctttttcaaaatctcactgagaaatcccggacaagggtaggacttttagccacttcagcagggaatttttttaaacaatgaatggtagggacctgtggtcataagttttggaactcgtaaaggccctttgcttcttactagcgacctttctgaagtcgactaccacgagatggagcaccgttagtggagctatcagtgtccctgcttgtttctatgcatgggtgtaaagatgccacaacacaggtgtgaacacatggacttcatgtgtttaacaaacatttatggaatgcttattgcaaggccttggctttgtaaggtactgaggaaacaaagttgaatgatacatggtttcttttcttagggtactttagacctgtctttaaagtacttgtagtctgataagagtcacagccaagtcaatcaatgaatgcctggtgataagcacaatttcagaggtaaggctagggaaagtcagggaaggtggggggtagtcaggggagttagtctttccaaaggcctggctagagttcagaggcataagtggaattttgggactttccctctgagatagatgaatgagtatttcaagtctacttccttcaggcatggagcaagtgacctgtatttatatacagtggagttcatggcacaacagtgaaagaggaaaataacttattataaaagaaaaaatacctaacttagctagcacctagaacctgcagttcttgtttttctttaaatcttttttaaagtgctgttgtctttatttggtcttctcctttccttgtctctgtcccactttattttatgcagttaaatactattaaatactttaaaatatgctcattaaaaattttaaaggtatctttacagaaccaaaaccattgtagatacttaattaacactgttttgctgtataaaaggctctggtatttcaggaaaatagcttctaaactttaggtagtaaaatctattcctcagacatgtaatggtttcaccgtatagtgaagtgaatattcaactcatggcctggccttagctgtatgagtttggtgaagacctttacgcttttgagacttaatttccctcatctgtaaaatgatgtaataatacatttcttacaagcttgctgtaagaattccagtaacatagtacatatgaaagtgttttaaaaactgtaagtagctatatgcgtattgacaatttttttaaaaaaataatgtgagacattaagaaaatgtgacttggagattttaacaagttgatttttaaactggggcagtacttgaaatttcatcctgtttaggaaatcagaactaatggattgtacttaatgttatatttagtttaatagccatttgtaaatgtgctgctttgcagaatcatttgcattaatcgtggtgagatatatttggaaggaaaaattagaaaatcaaatttttaccctcagcattgttttcattttgaagtagtgttttttggaaatggagtaaacacaagtagaagagtattcaaaaagtaaaaacatgtcaccagagccttttggcaacttgtcttatttaatgattttgtctgtattctttcatatttcatacacactggaaatctctgcatcataactattaagttccgaaaacattaaaagtgattgtctaaattttggattctatgggctatcaagcaatagctctttttaggcctcttagatattaggccaacggtatgtaaatttagtcattggaaatattcttctaaatcacacctttaagatagcctgaagggcaatcagcatttccattaacaacaaaacaaaaatatgtttctagtaattatcccaggggttttcttttatgacaccaaaagagtcctatcccataaattagcctaaccaacacttaaataatatccttatttaacagaaaaatttaaaggtactttttcctatgtagtcttagaataaaaggtaatatctacttttggtctttgatgatggtgatgtacagacgggtttttggtgtggatgtcctttctctttgttagttttccttctaacagacaggacactcagctgcaggtctgttggagtttgctagaggtccactccagaccctgtttgcctgggtatccgcagcggtgtttgcagaacagcagtttttcatgaaccgcgaatgcagctgtctgatcattcctctggaagttttgtctcagaggagtacccggccgtgtgaagtgtcagtctgcccctactggggggtgcctcccagttaggctgctcaggggtcaggggtcagggacacacttgaggaggcagtctgcccgttctcagatctccagctgcgtgctgggagaaccactgctctcttcaaagctgtcagacagggacatttaagtctgcagaggttactgctgtccttttgtttgtctgtgccctgcccccagaggtggagcctacagaggcaggcaggcctccttgagctgtggtgggctccacccagttggagcttccctgctgctttgtttacctaagcaagcctggacaatggcaggcgcccctcccccagcctcactgccgccttgcagtttgatctcagactgctgtgctagcaatcagcgagactccgtgggcgtaggaccctccgagccaggtgcgggatataatctcctggtgccccgttttttaagcctgtcggaaaagtgcagtatttgagtgggagtgacccgattttccaggtgctgtctgtcactcctttctttgactaggaaagggaactcgctgaccccttgtgcttcccgagtgaggcaatgccttgccctccttcggctcgtgcacggtgcgctgcacctactgacctgcacccactatctggcactccctagtgagatgaacccggtacctcagatggaaatgcagaaatcacccgtcttctgcgtcactcatgctgggagctgtagaccggagctgttcctattcggccatcttggctcctcaccatcatcaaagaccaaaagtagataaaaccacaaagatgggggaaaaacagagcagaaaaactagaactctaaaaagcagagcacctctcctcctccaaaggaaagcagttcctcaccagcagtggaacaaagctggacggagaatgactttgacgagttgagagaagaaggcttcagacgatcaaacaacgagctaccggaggaaattcaaaccaaaggcaaagaagttaaaaactttgaaacaaatttagacgaatgtataactagaataaccaatacagagaagtacttaaaggagctgatggagctgaaagccaaggctccagaactacgtgaagaatgcagaagcctcaggagccaatgcaatcaactggaagaaagggtatcagtgatggaagatgaaatgaatgaaatgaagcaagaagggaaatttagagaaaaaagaataaaaagaaacgaacaaagcctccaagaaatatgggactatgtgaaaagaccaaatctatctctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaatgttaagggcagccagagagaaaggtcgggttactcacaaagggaagcccatcagactaacagcggatctctcatcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccattgagactaggaagaaactgcatcaactaacgagcaaaataaccagctaacatcataatgacaggatccaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggtaggggtttcaatcctagtctctgataaaacagactttaaaccaacaaagatcaaaagagacaaagaaggccattacataatgttaaagagattaattcaacaagaagagctaactatcctaaatatatatgcacccaatacaggagcacccagattcataaagcaagtcctgagtgacctacaaagagactgagactcccacacattaataatgggagactttaacaccccactgtcaacattagacagatcatcgagacagaaagttaacaaggatatccaggaattgaattcagctctgcaccaggcggacctaatagacatctacagaactctccaccccaaatcaacagaatatacatttttttcagcaccacaccacacctattccaaaattgaccacatacttggaagtaaagctctcctcagcaaatgttaaagaacagaaattataacaaacgatctctcagaccacaatgcaatcaaactagaactcaggattaagaaactcactcaaaacccctcaacttcatggaaactgaacaacctgctcctgaatgactactgggtacataacaaaaggaaggcagaaataaagatgttctttgaaaccaatgagaaaaaagacacaacataccagaatctctgggacacattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaagatcagagcagaacggaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcatcctgataccaaagttgggcagagacacaaccaaaaaagagaattttagaccaatatcctttatgaacattgatgcaaaaatcctcaataaaatactggcaaaccaaatccagcagcacatcaaaaagcttatccaccgtgatcaagtgggcttcatccctgggatgcatggctggttcaatatacgcaaatcaataaatgtaatccagcatataaacagagccaaagacaaaaaccacatgattgtctcaatagatgcagaaaaggcctttgacaaaattcaacaacccttcatgctgaaaactctcaataaattaggtattgatgggatgtatttcaaaataataagagctatctatgacaaacccacagccaatatcatactgaatgggcagaaactggaagcattccctttgaaaactggcacaagacagggctgccctctctcaccactcctattcaacatagtgttggaagttctggccagggcaattaggcaggagaaggaaataaagggtattctattaggaaaagaggaagtcaaattgtccctgtttgcagacgacatggttgtatatctagaaaaccccattgtctcagcccaaaatctccttaagctgataagcaacttcagcaaagtctcaggatacaaagtcaatgtacaaaaatcacaagcgttcttatacaccaataacagacaaacagagagccaaatcatgagtgaactcccattaacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtcatttatagattcaatgccatgcccatcaagctaccaatgactttcttcacagaattgaaaaaacttgatcttgaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacaactgtctgatctttgacaaacctgagaaaaacaagcaatggggaaaggattccctatttaataaatggtgctgggaaaactggctagccatatgtagaaagctgaaattggctcccttccttacaccttatgcaaaaatcaattcaagatggattaaagacttaaacattagacctaaaaccataaaaaccctagaagaacgcctaggcattaccattcaggacataggcatgggcaaggacttcatgtctaaaacaccaaaagcaatggcaacaaaagccaaaattgacaaatgggatctagttaaactaaagagcttctgcacagcaaaagaaactaccatcagagtgaacaggcaacccacaaaatgggggaaaattttcgcaacctactcttctgacaaagggctaatatccagaatctacaatgaactcaaacaaatttacaagaaaaaacaaacaaccccatcaaaaagtgggcaaaggacatgaacagacacttctcaaaagaagacatttatgcagccaaaagacacatgaaaaaatgctcaccatcactggccatcagagaaatgcaaatcaaaaccacaatgagatatcatctcacaccagtttgaatggcaatcgttaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgtggcactattcacaatagcaaagacttggaaccaacccaaatgtccaacaatgatagactgaattaagaaaatgtggcacatatacaccatggaatactatgcagccataaaaaatgatgagttcatatccgttgtagggacatggatgaaattggaaatcatcattctcagtaaactatcgcaagaacaaaaaaccaaacaccgcatattctcactcataggtgggaattgaacaatgagaacacgtggacacaggaaggggaacatcacactgtggggactgttgtggagtggcgggggagggagggatagcattgggagatatacctaatgctagatgacgagttagtgggtgcaatgcaccaacatggcacatgtatacatatgtaactaacctgcaccttgtgcacgtgtaccctaaaacttaaagtataataataataaaaaaaaagaataaaaggtaatagctgattaagtttagagaatactgattcttatcctttttcttcttctaccatttcctagttcggcaaccatgcaaagaagcgagatttagaaatggaatgttgaggtgtgtttaagatggtatttgtccaggctattcaggaacacgcaagccctgtcctcagctcaacactctctccagaagatcatcggagaaatgtgtacacagagaaacaaaggccaaggaaccctttattgttggctgaggttttgtcttcaaacccagaagcagaacactggtaaactatatagagccttctgcttcagaatagcctcgcagcaaaacaggctggtggttgtactaggcttgctcttttacttgaaaccaaacctgaaccatgagtcttccttctcttctacagtgaaaggctagaatatagctttcagtgggaaaaactcctgtcttgtgtaaaccaaaaagtatctgagacaagtctcaatcaatttataagtttattttgccaagattgaggacatgcctgtgacagcctgaggcggtcctgacaacatgtgcgcaaggtggtcggctacagcttggttttatacattttagagagatgcaagacatcagtcaatacatgtaagatgtacattggttcagtccagaaagcaaggaaaactcaaagtgggggtggatggtggggcagggagatgggcgtccaggtcatagatggattccaagattttcagattggcagttggttgaaagagtttatctaaagacctagaatccatagaagggagtatctgggttgagataaagggttgtggagaacaagtttcttcttatgcagataaaacctccaggtagcaggcttcagagagaatagattataaatgtttcttagcagacttaaaaaggtgccagaagatcagggaaaagacctggaaagggaaagggaatctctatagaatgtcaattatcctcacaagagatagctttgtagggccatttcaaaatatatcaaaggaatatattttagggtaaaatacttcagtttctttcagggccttctatgtgccatatgatgctgtactaaagtaaggctggaattttttttattgctacaataaaactcttttattgctacaaaaagtcttaaaatctctgtttcaatgttaatgctggtcacttgtgtatgaattccatggggaagagggtataatgaggcatgtcttacccctctcttcccatcatggtctgaactagtttttcaggttaactttggaatgcccttggccaagaggaggggtccatttagatggttgtggggcttagaatttttagtttacacttgatactcgaaacacagctggtgtaggataattgtcttagaattcaaaaagttcagataagccgcctacttccccatgtatggaataagggggatgctgctcaaaggtgtggggagggtggagataggaacagccttctattaaccaaagaagccaattgtaggcaacgtactagtctctaaccatcatgctctcagatttccagagtttgatactgtgtgctccacatagatatgtatagttcttggtaggtgaaacctatttcaaaactgtcccagtgataaattttcacaaggctgtctttgatggcttccttctacatcccagcccttgttggaggctaattttaacctaagaaaaatataattgccaaggttatattatatttatctaaagtaatggaatattagagtttgattaccattggagggtaaaggcaggaagataccaactcagacatagcttgggtgtggtgtgtacattcctataacttctaatctttataaaaatctttatgagttacagctgtaaaatatggttgtagtttttcactgtcctttattacccttaagtattccccaccaagggagtgctacatatatgccatatttgcagtgaaataagaatttattaagaaatacattgtagtatgttttattaaagtaaaacacacatatgggtatgcatagatagatgcaaaaatcatgtttacttgatgatttttcacaatgtgaacacacctatataattgtcactcaaattatgaaacagaacatgagcagtgttatatatttgtttttaaattcattaatctctagtttttattttcttcttttgctttctttgaatttaatttgctgttttcttatttgttaagataatatatttagatcattagactttagcttttctttttttgtaacattgacagttaaggcatgaatgttactgaatgcatgtttgcagcttcattccacaagttttgatatgtcatgtgttcatattatgagtaatattgactttaacaagtcaatgatataatatttttatctctaggacaagtattttgttttttaaatggattccatttaaattcccatcttgaaatcaatatttaaaaaatatgatgttatttcaaagtctgtgtctgataaccatagtatataattctcctttaaggttatttctaatttctgtttttaccccctcttgggattccagtcatttgatcttgtcttctgttatgtctaacaacttctgattaaatgtcagatataaaatatccatagtagagataattttatactctagatgatattatcttccttcagagattgtatttgcttttggctggcatttgggttaggggcaggtcaccttaatattcagcctggaattaagctgattggaagctgaatatagttcaccaagtgcataggcttacaaccatccacacagaatctgaatcttgggattcacagtctcagagatacccgccatgatagagaaatatagttgggcctatgaaacagactccgagtaaacttatctaaccagccacatagatgaagatgtcaagtctgtttttttctatttaattgtcttactgtaagagaaagaagtcagcttgcttcctgtcttcatgacactttaattttcccattagaaagaaagtccccttgaatttatcaaactctaattcatcaaattggccacattccctgaggtgcagagaagaggaataaataggcagaggccggaacctggtaaggtgagagaacacttctttctaccttaagagttaatattgttgtttgcatatggtaaatgaataaattcatagtcagagagcataaataacctactaagatgctgttagacctgggctctcccttacacttttgagtttcttggatcttaagattctacagtatgtaattattttctaacactattattttcagcactgcctaaaagccagtctcagtgagatttaaaggcagggtggccataataattttccttttaaaccaagacatttttgagaatgaaaagaggtactattagtcattacgccaggacaatagggtaaactgggactgttatgggccaactggtaggtatggtgatcttactttactactgatacagataccttctgcaatggaaggtcgtggaattgggtgacgttgaatgattctgagcttaccacatgagtttgtttgaaaaataagagctgaaaatacccgaagacaatggaagggtgggggacaggagaaaattagcaggacgaagagaaaataaaccaagaagaagaaatgaagagaggaaagaacaataagaatgccagaaatcagatatttgcccaggaaaacaggtgaatgttagcatgtggacatgaggcagggtaaatagaaaacaggtacagatttgaagattaaaatcatcatggaggggaaaaaataatgtatagaatgagatagcaatgggtataagctttgcaaaaagaacgagaaagtatactcaagtttagatgatgttataatatcatttatagcaaggacattgaagagcctacaggataacattctagtaaattagatttaaaggacaaattgtgagtattcctggttataaataacactttattattgatgcaattattttaacacatgcagaaacatggcagagaaaaggaggtagtgtttaaatatctgcccagtgactgaggaatactataatatcctggatctacaggtgatgctgcaggtctgagagcaatggtaaggaagctaggaggacgtaatattaatgatatgattatcccacccatatagataacctaaaatatgtgaactgctttcatagaaggcagaagaatccaagacctgagtggagtgtgaaagattgaactttaaaaatagctatgtgtgatgcatattacttgtgtatgaataacttttccatcatcacatagaactgtcatctcaggttaagcgacctcttatgctaatactgtgatagctgggttgttgttggaaaaccactcagaaaataagaaaggttaaaaaaaattgtaagataaaacatttatagcagaaggcaaaatatatacttctgagtaactatagcatcactatactctggaagaaagaatacaggctagtgtaaaaggaacctggaatgtaacatctggattcacagagctgatgttaatagcctggtaaagacaaaagatcacaaaatcagtgaactagtcaaagtatttttgaataattgtagtaccacaaggcagccatttaaaattcactcctctgaagcctaggttggctaaaggaatttttgtttttcactctgtgtgttcttgtagttgaccctgcataaaatccaggctggttattttttgaagaaacaacttacaatctataagaaaggaatgttcaacttcaccataggaattcagtccaaatgcatttattgagcgatatcaacctgatatgaaagccgtatattctattcttgttttatcttttattgttctttatattttctggtcctatttacctctttgtttaatctttacattttttctagtactttattattgttcacagtttattgtgtaagcctagaattggttttcatgctttagccattacttttcctttatgagatgttattgtacttggaaaagataatgtgtgaatcagtgtttgatgagccaaaattatgggagagatttttaaactttgacttagagaagaaccttttttgaactctgttactaggtgtgattggtgtgtcttgtgacctcccattggacagtgtactttttatatggtatttatgtttcttttttcattgcagcattacagggtgtctgttttctacagtgccttcttattactaagctttgaacattgtaggcacccataaagtctgaggacatttaagtacatttgagagtaggattagatggaagatgagaaaatttccatccaaagcagaattttctaatctgattctgtatcataatgtgctttatttatttcccagtgggatataaagcattcctaggtatactaaagtttccaaaaaaaaatctgtagtacagacagttgtttaatttcatttaacctgctgttcctcacatttatctgacaaatacacttttgtatctgggctctgcagtagacagaaatgcacctcaaattaattgaagcccaaaaggggatttagtggcttatgaaactgggaagaattcttggtgagttcacagaacagacaagctgcaggatgtcactgactgagactggggactcaacagtctttctcttcatccattttcctcttttgattctgctggtttcattttgggtgctgacctcaccctttcctggtgtggacagtcctgtgccctttcaacacgacggggaacaacctcagctgaaagggaacatgttgatttctacacttctaaatattgatttttccaaaaggtttcatccctgtgattggcctccatgctgtagaccaaccactcttgtcaggggaggagtttactaagattggctatatctaggtcttttgtccacatatgtggcctggataggatgtgtagaacccacttctttaagaagagagttaggaaggcttgttgggaagagcagaaataataaccatcactcatcattcaacaaatatttattgaacgtttttcctcagcccctcaggcacttttctagacattagggacctaacactgaacaaaataaatgaatattccttcttccagggagcttacattgcagtgtaataaaaaggcaacattctaataaaaatgaataaaaatgataaggaaaacagtatgtttgactacaataagtacaaggcagataaaataaagcagaagagtaagaagtatctgtggggagaagggagttaaaattttagtgtgtccagggaaagcctctctgatgagaaggtcacttaattaaatattggaaggaagtgaaggagggagccctgcatatatcccattcagaggacacagcagatgtgaaggacctggggcaagtgtgcctggtgtgtctgaaggaggacatagagagtagaatgtgggcatggagaagaccatggaggacatggagggtagagtgtgggcagtaggttccagatttaacctttaaaatccgaatttttgtgggcattttatggtcttctggtctgatttctagtgctacagagtccattccttcataatatttattacagctgaattatgtgcagagctgctgttcaggcaccacacatttttattttagaatagctattggtttctcttagctattgccttaaaatatatacttctaattttttagtgtgggtatagtgattgtagtactggtaaaatgatttatggaagaatataatctactgtgagataatctgcatgtgttgtgaatcaggtagttgctgtgacaaatccagtcagtaggttccagattgaaccttaaaatcctcacttcttttgggcattttatggtcttttggtctgattttagtgctacagagtccattccttcataatatttattacagctgaatgatatgcaaagcaaatgtttgatacagtggagaatgaactgatcttaccttgtgaaacttggggaaaagacactttggcaaaaatgtgattcagaaatgagcacttatgaagttcccaaggaattgggctgagatagtaggaagtcttgtgctgagctctaaaggctgtttataaaaagcagacgtgaggaaaaggcaatttttgataagaagtgtaggagtgtaagtatataaaacagaagaggattatggtcaggtcacctgcctaactcgagcaaggagtctgctagagaaaatgggaagtaaaatcagattattagaaagctttgtgttctgtgttaataacgggaactctctctggagagagtttgaggaagattattctagaaatgttgtgtcactttgggccacttggccatattccacactctgctctgtgttataggggacaatttataattgcaacttccttaggtaataataacagtcttggcaacttgatgtttttttaggcccttcccatggatattcttttcatatctgtaagatgtaaatttttttaaaaatattagtatttcttgaaggattaatgggagaaactttggaaaattccctactgcttagaagtgattttgtttgtagcatgtaagatatatataccttctctttgcttttttttctttttcctttcttggtttccactaaattcttagccctaagttccttgcttttttgtctcagctttcttcttatatgaagtatcaaatttaaaaaaatctttaaaaagcctacagagggtgatggagcttagggattagttctcatgccacttattttccctaattaagaactctgaaatggaagttgaaaatgttggtataacctttttattaatggggaaatggggtcatgcctgccacttccatctccacaacaatccattgtataaaatgttaagttcactggtacttttgatttgaggggagagacatttatattggataagtatatatcagaagtctgtgtcttttgaatggtcttccgaaattcttatctccattcttctataattgttgaattattttccttaagctgtactgcagaataacacctataagataagctttcaaagtgactgtgttaagcagccttcattctccaagaaaaccactttgtgccttcttttctcaaaacctcacacaacttcctccccctcaccattagcttactagtatttcactgcaaaaataagtcctcagaaacctgcatcataatcccgccaaatctcccaatcacccccattagtctcatctagtctgccttccctagttagtattgataaactctgtgtgttcccatctaaagctaacttttctgcctgtgatttggatattgtctcttttcagtagtttaaagatacttaaactgcttctgcatttatcccctatctctcctgcagcattaacctgtctctactagatcattctcacattccaaaattgctgtaatatctgccataaaaaaaagaaatctgtaaatttgtttaagtttcttgtagattctggatattagccctgtgtcagatggatagattgcaaaaattttctcccattctgtaggttgtctgttcactctgatgatagtttcttttgctgtgcagaagctctttagtttaattagatcccgtttgtcaattttggcttttgttgctattgcttttggtgttttagtcatgaagtctttagctgggaggcaggaggaacttctctaagactcaggaattctacttttagttatacatattaaacaatctcaaatattgaggtcataaggaaaatattataaggtgttcattccaacactgcagagatatttataactgccaaatagtaggatgtataagttgtggtatatttatacagtgaagtagtatgcagcccttaaaatgaatatagtagagctactttcatcagtgtggatttctctcaaaagcataatgttgaattagaaaagcaaggtaaagtatgatgcattgagtatgatactatttataaagagcttgaatgcctgagaaacaatactatatcatgtgtatgcccatacacatgtataatacattttacatgataattataaacactggttttagaaccctagggaaaaagtgaaggaaatggagttgggatgtactcaactgttggtgtgggatgttttttctttaaaaatgaagattgaaacaaacatgacgtaagggtaagatctgataaagttgagtggttgatacacaggaatttgttattacatactctattttacagctacttttgaaatttttctcaggtaaaaagtataaaactaacataatacaacaatttttaaaataaaatgattgctaccaaaaaacaacaaaaaaaacccttcagactggtagctttaaacaactttaaagcttgagctccttctaaatttcccaaagtctttcagcactctctttcaactgggcctcctcttcagaagtcacctttatctttataagatctgtagtactattctgtcctaggatacaaggaatgctaaggaatgttacttcatttatcccataaaagctctcaattatgatggaaactggatgcaccctcttaagattattcaaagaggaagtcaaattgtctctgtttgcagatgacacaattgtatatttagaaaactccatcatctcaggcccaaatctcctcaagctgataagcaaattgagcaaagtctcaggatacaaaatcaatgtgcaaaaatcacaagcattcctatacaccaataatagacaaatagagagccaaatcatgagtgaaatttcattcacaattgctacaaagagaataaaatacccaggaatacatcttaaaagggatgtgaaggacctcttcaaggagaactacaaaccactgctcaacgaaataagaggacacaaacaaatggaaaaacattccatgctcatgaataggaataatcaatattgtgaaaatttggccatactgcccaaagtaatttatagattcaatgctattcccatcaaactaccactgaatttcttcacagaattgtaaaaaactactttgaagttcacatggaaccgcatatccaagacaatcctaagcaaaaagaacaaagctggaggcatcacactacctgacttcaaactatactacaaggctacagtaaccaaaacagcatggtactggtaccaaaacagatatatagaacaatgaaacagaacagaggcctcagaaataacatcacacatctacaaccatctgatctttgacaaaccagacaaaaacaagcaatggggaaaggatttcctatttaataaatggtgttgggaaaactgggtagccatatgcagaaaactgaaactggatcccttccttacaccttatacaaaaattaaatcaagatggattagagacttaaatgtaagacctaaaaccataaaatccataaaagaaaacctaggcattaccattcagtacataggcataggcaaagacttcatgactaaaacaccaaaagcaatggcaacaaaagccaaaattgacaaatgggatctaattaaacagaagagcttctgcacagcaaaataaactgtcatcagagtgaacaggcaacctacagaatgagagaaaagttttgcaatctatccatctgacaaaggactaatatccagaatctacaaagaacttaaacaaatttacaagaaaaaaacaaacaaccccatcaaaaagtgggcaaaggatatgagcagacacttttcaaaagaagacatttatgcggccaacaaacgtgaaaaaaagctcatcatcactggtcattaaagaaatgcaaatcaaaaccacaatgagattccatctcatgccagttagaatggcgatcattaaaaagtcaggaaacaacaggtgctggagaggatgtggagaaataagaatgcttttacactgttggtgagagcataaattagttcaaccattgtggaagatagtgtggtgatccctcaaggatcttgaactagaaataccatttgacccagcaatcccattattgggtatatacccaaaagattataaatcattctgctataaagacacatgcacacgtatgtttattgtggcactgttcacaatagcaaagactgggaaccaatccaaatgcctataaatgatagactggataaagaaaatgtggcatatatacaccatggaatactatgcagccataaaaaaggatgagttcatgtcctttgtagggacatggatgaagctggaaaccatcattctcagcaaactaacagaagaacagaaaaccaagcactgcatgttctcactcgtaagtgggagttgaacaatgagaacacatggacacagggaggggaacatcacacactggggcctgtcagggggtcaggggtcatgggagggataatattaggagaaatgcctaatgtagatgacaggttgatgggtacagcaaaccaccacagcacgtgtatacatatgtaacaaacctgcacattctgcacatgtaccccagaacttaaagtataaaaaatacttttgcactaacctaatagtaaaacatgactagattaatcagctcatacaatgtgaattattgaccagtatgaaacagagaccaaagtcagtgctggctactacttaggagatgcaaagataattcctctgatggatttctagattcatttaattgcttaatgacttagagataattaattctcaacaaatattcatttgaaataaattctgacaagttgtccataatccttccagaattcagtaataaatcaaatgcaccttttttttttctccttgtaacttcccattgacagtgtcatgtcattaaaacccaggctatgtgtggctgctctttcccactgcagtgaaagacatttcaatgggaaatgagtttgcctattaaaaaatgtttactgttgttttctattaaaaaaaaagattcttcaaaatactttctgttaaatcagctacagataggccaatggtccaattagtacaacctttcattttaactatctcatagccacaggcaatcacttctttgtggactttttcccactgttcaggatctttatcagttcctatatctgagttcagatccgtcagagggatgccagcaatattgactccactccacacaggaatacttgagtccctatgctgtccaagaatccacctatgacagctttcagagtggatatcaagcctttgcccagtgaagaaacggaaatggggagtgtccagattacagccacttccaataacacggttttggggaaatacactcaatttccagaatacataagttacaatatccagtaaattagaaactactatcagtttgtggtggggattgcatcgggtaatactggaaataattaatttaaaaatgatcacatttcactggactatatcaaggtgtgtttctccttttgctggaacacctgctgtaataatgactaagttggactttgcagtgacactgtagtctttgctgaaaacaatgcttggcatttttatggaagggctgccatgttgaagatccgttgtctcacccttcaatttgccttcgtcaacatccacaaaggcaagtttatcacccaaaccttttaataagatgctgagagcacaggccatgccaactgatccagttcctataatggagatcttattgggatgagcggccccctccaaagtgaaattcttggcaagttcaagcttgacagtcaccatcttggaaatgggagtgaaggtccagccgcccctgagtgggatgtgtgtggcctcgtgggggcactgagccagcccccaacaaaggaaatgagctcctgcagcacctattctcttgctggtgggcagaactcctgcagctcagctcatggtcgttagctcacgcaagaggcaaatggatgaaagcagcggcagaaatctccttgaggtgtggaagaaaccctgacggtttgaaggcctcctcgccctttgctactgtggctgcgcaaggccactcccagctcgtgcagggctcacagagacctggccccttaatatgttatttttagttttacaaatatgtggtattttttacaccattaagacggttccgaaaaaatggactgtgatcattaaggccaaaagtaattttagctttgcctttcaaagtgccatattttgttgcttagagaagcgctgcacctttgcaattatttttgtcatggtgctcaaacacgctgaaactaagtacgatagatgcaaagacaaagagatgagaattccaatctccactccacacttggactttgaagaagtttgactatgtgagcttcttttaaaaagtcaatattacaatgtgataataagacttgtcctaactactttacaaggttcctgtgagaaagtcagggtgaaaagtctagggagctttaaaaagagtattgtaactatttgacaaactatgtcactgagtcagtgacaaaaccaagtcttctgatttttccttcttcatgaaaatgatgcattaaaaattaaagaaataaaagcttagaagtcctcaattatctgcttttttgaagataagatagtcatggataaatgcaatcattcgataactagtaatgtttagataatctcaaatccttctaccagaactttaataacatttattcaaaatcaaatatctgcctctttccccaatcaccatctcctttataattaaaaagtgaggactatgaaaaacaagaaggcttaacccatgaattaaaatgatatttctctaatatactgaaattttgccttatgaatggttaaactacattttctttaagttggcaagtcttaatatgtgtttacctatttatattatcccaaataagaaatttgatggaatcttttcacttctcaaccagttgtttaatatttggtatcaggatgcattctatttgtaaatataatagttctatctcagaaaaaaaaaaaagaaagaaatctattttattctctcctcccctagcttccccatttctcagctttttttgatagcaacatttctcaaaacaattatctttactctctggtgtccactgtaacagctcttgtcaagatccccagccagacacagtggctcacgcctgtaatcccagcactttgggaggctgaggcgggtggatcccgaggtcaggagttcgagaccagcctggccaatatggtgaaactctctctctactaaaagacgaaaaaattacccaggcatggtgatgtgcacctgtagtcccagctactcaggaggctgaggcagaagaatcacttgaacccgggaggcaaaggttgcagtgagccgagatcgcgccactgcaccactgcacttcaacctgggcaacagagcaagactctgtctcaaaaaaaaaaaaaaaaaaaaaaaaaaaaaaaaaaaagaaaagaaaatccccagcacctccatcttgccaaatttattcgtccattcttagctcccatcttacctgaaccttcagcagcctgtgatttaactgattcactctccttattgagctgtttcttcacctggctactggtgaagtcttggttttcctcccctttttcagtgttctctgcctatatcttctcctattcctatacaaattagggtgacccaggacttaactcttacccctctgctctatctacactcacagccaggattgtgccatcctttcttatggtaccaaatactgtttacatggtgatgtctctcaaatttacgtcttccctctccgtctttctgcttgggcttttggtaggtaattcctgcctaaaacttccaaaactccttattgtagcctattgggtcctacaatctggttcaccccttacctatgcaacttctttgcctgctgttttctctcctttgttccttcagcttccaccacatttggattctttcttatcttgtaactgccaagcagcttcttctcacaaagtctttgcatttcccattcttttggcctagaatgttctttcctccaatttttgcatagcttgtatctttactccagtgtcaaatgtatttcttcagaggccttcccctatcaccctgtctaagatagtaccttttttacttgttttatttttttttcttagtacttatcagcactttatattttatttttcctctgtggtaatatgagtctaaagagggcatgtaattaatctatccacccctgtttccctaaggcttatagtattgcctggcttatagtagattttcaacaacttttcgttgagtgaatgaatatataaatgaatggagttgtatgatacattattgttttatatgtaaaccatgtgattaatccctcaatatttttgaattcaaggtacagataaatgtttactataatataatgtttaaacataatgtaaaagtggctagctagaacatgttgcatgtcaatttgtaaaaaggaatttcctgtgagtgatacatgggaaggccctttttgttcccttctctggaactaatagtaattccacaggaaccttgtggaactaaattgtgtttccttggttcttctcatgcagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggtaagctgctctcctacctggggtctacaatgtgctaatagggttatctcctcccattcaggctggagaatcaatagaatgaggaaatatttagtgcaaacacattggagaggtttaacttgaaataatgactgtttgacttttatactgtcaaatttcttggcacttatatagtaataataatagcaattataatagtttattgggcagtgtactaggttcttcttttggattattctacttaatccttacaataatattttaagggacaaactatagttatctggttttacagatgaaaaaaggtctaagagtttaagtaatttgtccaaggtcatacagttagtaaatggttcagaggtcatagttgctttcatttactctgttttatcagaaaattggtagtaggtttatacacacatatatatattaaaatcatcaagctgtatacttaagtttgcatacttcactattaaatgttgtgtcacaaatttttgttttaaagtgaagtatattaatgttattataatcacgtactcatttcactgcatagtacctgagaagtcatcctcttcatccgcctctgaaactgagctccacagagttaggaagcttgacctgggagtgcaattagttgactagaagttaatgtttcacttaaatttgtgctgcagacagtttaaagaaaacttgtagtcttcaggttgacagaaaattaaaatatgaataggacttttttttgggatggggggtgggggagttgttttctgtgggttccagggcaaggacaggttcctttaggtttcctcatgtgagcaggaagggctatgaatcctcctcagtgatagatggatcctcctcagctcagacggtctgagcatgattaaccaacagtgtaaagaggctcaagatttctttagagcctggttaggaggaaaattaagagaaaatttcctttaggcttcttaattcatagattgcaggctattcttcctcatcatacaggtattttttaaacccatttttatatttcttagacacttaaaataggaatgatacatagggctgttattggacaaatagcagtggaaaagagatgatcatagcttattcacttaataggattatgatgatttgtgttttctgtaacgtagctttttgcttgaaaacattccagcagagccttgtggttctatctgtgcagtcacctggcgaacagctgactcagataatggctggagtccagctctgtgcccctatggctttatttatgtctctctagactaactttactaggggttgaaagaaaaaaacatgcccagaagtgttaaagaaaattgctcttggcttttcatttttattaccatttttctttagaaggtacaaataaaaaatgctttaaaagacttttatttaacaaaatacgcattcattgagagcaaatcatgaccattttttgtgtcctgcttatcatttctttctgtctggctcactaacttttttcttttataatggatggtagggctagtgtagaggtaaaatacagcatcacttaaattagcaaaaggagccaggcaattcaaggcaacgtaattcaataatattatataactatttcagggcaataatctgaacgatatatccttgcatgttaacatttttccaggaaatagcttcatccatttgctgtcctctgaactagtacaagccttaatcactgagtagggagtctcattagctttttgtgtgtaggtaatgtggggtcatttacagtggctgcatcctgtgaaatccaataaaggaaatcccacaaggaatgtggtaggcatggtgaaggactgcatgtacatttcatgatatgttttaatgtgcatgctactctatcgtactgaaaggaaacctgaaaaatctgtgtttgtgtgtatctttttatggtcatttttctttttaaaggtggaggaaagttatgctgccattattatgattatttctgtttctaataaacagtattactaccatgcaccttctaggaaatatggctctagcagctcccatttcttgtgcggagttcaccaatttcattatttactctcttacttgcttgatctgttttagcctccacttacagctggatgactatcaaccgggtgaatgtctatctatgtaggggcccctcttgccattcatgtgaaaggaaacaaaccctattctttgatctttggttactggataggatatgtttatgattttcctagtatcttacaggcactttgcttgctgtcatcttatgtctatccacagaggccactactctctctctctctctctctctctctctctctctatatatatatatatatatatatatatatatatataaattttttgaaggggggtgatagagtcttgctgtgtcacccaggctggagtgcagtggcgtgatcttggctcactgcaacccccgcctccctggttcaggcaattctcctgcctcaacctcctgagcagctgggataacaggcacctgccaccacacccagctaattcttgtatttttgtagagacggggtttcaccatgttggccaggctggtctcaaactcctgacctcaagtaatccacccgcctcggcctcccaaagtgctgggattacaggcatgagccaccgtgcccagcctcattcatatttttgagctatataggggatgaatgttcttcttataccattttgcagttgagagatgaaggcaaagggaagattcagcatcagtgctgggaatagaactttaaatagatttctgaatctgagacaagagttttagggacagcctagggagattctagaaaagattggaataaaatgttttagggttctcttataaagaagaataaaaccctagtttgtgcttttctaatcttgatttgcacatgtaaggtaattggttattaagtaagctccagactgttaaaaatttagaatgtttaccctcttagtggcactgtaagataatatatatatgttacaaataattatttatctaaaagaagtagtttgtgattaattgtcaaagccattaaaaaaacttagagggattgggatggagatcctgctagttcaattttgtcacatccaccagtttaattgctagctgctattaatatttaccgcatgtaatgcagttggttatggtgggtttgtggtcctcatgaatccattatggaagccacagtttagccacattttccaaagctgataaagatgaataatgggttattgaattcactgttgttttgagagaaggatataaaggattggtacatgctgagtttatgctagaaatagctgtgatgtatcaggaaagaggggggtgcatatcttttccgaaaacatcaagtggtttaggaaggctagctccttttctcatattatgctctgtttctgcttataattattttgtgaatgtgagtataggccgttggttccggacacagattatttggttaatacatccttttgttgtggagaatgctggaggcatcttccgcaggcataattaactatatgaaaaaactcagaaaagtagaaaagggcctcatgaagattattcagataactagacgctattaaaaattgtaactctgacttatttatttatgagtgaataaaaagaacttagtaacataaattaatgctttttttttccaagctgtcaaagtaggctgtgcccttgcagccacacaaatgtgatgtttactctaatttgttaatagagaaaaaagcttctggataaaaataacatctgtccattgacaaaaaacagcttgggtcatgaaaggagttttcagtacattataaaagctgagtttggcaggatgtacttcaatcataaaagttgtaacagctttcgcttctttgaaggttaaaggagagaaaacatatttcaggcagagggaacttcaacttgttggattgttttgtgttcagttttctcggatttctcatcccatttcaataatgcagtccagattagaagcttcttaaaggtgtccattcctccagatgacatttttggcttgaggttatgtttcctgctgcttatgaatgcttggattctctctatttatcattttaaggaggcagatttactgaattattcctgattggagtaatgtgaaaattttaactggtatgtccaccatgttggtttggcccttggtgttattccattaatgaagaaataccttctttaaaaaataaaaattgcattacccaggaaagaggaatactacttttatatctgtgttactgaaccaatataattctcatatattgtgtttattgctatcgtgtagacaccattgatctgctgcttcctttcattctttgactggttctatttagcagagaacaaagagtaaatattttatagaaaatgtctgtcctcgtctcataggatgtaacttggaggctccattactctatcagctattggaatacccactgcctgccaaagtttatgtttgaggactattaatgactgagaatgttttttcactaactagacaatgttttggctttgttgctatatagtcaacctgataattaactcattatcagtgtcagttgataaatacatttccataatatgtatttgtaagctataatcatgatggaggtgctagggagaggtaggaagagatacagagtgtttggaaaagttttggatattatgcattactgaaaagttaatatttagatacatgaagataataaaaatggaagcagaagaaatctattatttaaaaatgtactaaggatccaggtgttagatattttctcttgtggcacagcatctgccccttttcacctaaacccacacccttattgaattgaaacatgaccatctgtagtcaggcaaacgaaattgagaaatgtgaccagtacttatgtttctcaatgggattaaagcattattttgctttaatcattaaatatattttgtgcatgttgcactcaaatcagtgatcagtccctttagaaaaatacactttacagtcctaaagaagcactttataatactatacgtagtggcatataattaggggccagcttcgaagggacaaaagttctagtgtcaattgaacttcagtgttaaaagagctgaaattcaattcaaataatgacttccttcatacttgaacagactttggtgcctgctgattgctatctactttggtaacacttgaaagtgagtgtgctgcttcacttcagagctggtttctaagcaaataagtactaagtggttttatggttattctggtataaaacctgagtattcaaactttcagacacctttttacattcttcatttctgggattttagaatcccttttgggttgaattttatgataaaaaaaaagtaattatacattcaagggcattttggaacagacccaaacattttttaaagtatttgctgtcaatccttttttatttgaagtgagggatataaataagtaagttaaaaataaaattctgctgagcaaaatggcaagctgtttctggtaccataaaaatcttacctaagatttcttgtccctggctaagcatccagaagtgacccagagtgacctatggaagacttatggaagtcatttttggacttctgttaaatcacaaccttggtatatcagttgggcaggtagtattaggcagaaatatgtggtgaaaagaacaggaggtaagaatgcctatatatctactctttgtcatttactaggcacagatcttgggctcttccattaacctccaccagcctcattttcctcaccattaaatgggaataggatactttctttactgcagagggtcatatggaaatgtaaataaagtgatgaatgtgaagtgctttggaggccttataagctgggcaggcatatgatgttatcatttttattgtcctcattatctccccgttaggtgatacatgatcaatatcaaggtgggatttatcccacgtcaccttttgtagatttttttgtaaattttttcttactcatttactcatcagatccccgcatccacagtgccaacatgccacagggcaaaggccctgtgtgataagtgagggattttttccaacttggttagaggtgaacctaagtggggttaagtttgttattgtatgtttcaggacctgtttgctatgaagcaatgttttgtgcattatgaagaaaaaatgttggtaaatgacaagaggacacccacaaaataattttgactgtctgtgaatgatgctttattttgaatttctctcatatttctcttcccttactttggctgtcaccatgtggcttacttgtagaggacttggtttttgctgattcccagtcacttctgagtagacatatttcttaaaagtgtggagacgatcatctgtcactgcccatattgggtaaggaaaagtcagagaaatgtgaagatgcactaactctttctagttattgtgcttgatgggtttgctccaaagattctgaaaatcagtagaaatggagagagaaaaaaagtttaaaatagaaagattgaatgactcatattaagcacttgaagtgcacctttcctgctcagtgaagaagcttctcaggtttctatgctatattctcatttgcctccaaataaactgaacaatgaactgtgttttgcaatagtgcgaaagagtatattctgtactaccaataatatattacctttgttttaaaggtgaattctagacctaacctttttatgaactaagttaaacatttctcagttttatgtatgttgagtttgatgaaatgtgtgttatagcctttgcttctttccttttccattaggttcttgttcattctcttaggtcctaaggggaaagccaagtcctaccacgagattggcagagccattgccaccctgatgtctgatgaggtaggaaatcaggaagatggagttctgtgaatgtcctacttgtttgttgtcatactgtgaattggctgtcacaatttattcaattagaattatgtggttactagacttccttatagcatgaggtacggtcatttgagacaaatgagctgaatcctatatggtttgcaaaaagtaaggcatgcattttggttttctatgggattctaaactctgttggaataaaacatattttcctttcttttaccaaacattttcatttcttaaaactgatatatgtcaaatattctttaaaaagttcaaagtcagctgggcatggtggctcacgcctgtaatcccagcactttgagaggtcgaggtgggcagatcacctgaggtcaggagttcgagaccagcctgaccaacatggtgaaaacccgtttctactaaaaataaaaaaattagccaggcatggtggtgcatgcctgtaatcccagctactcagaaggctgaggcaggagaatcactagaacctgagatgcagaggttgcagtgagctgagatcacgccactgcactccagcctgggcaacagagcgagattccatctcaaaaaaaaaaaaaaaaaaaggttcaaggtcattgtattaacttaaactttatctcttgaagttttaatacactaattctgggaattcaaatgtctatattctatattatttcagaaatgatgggttctataaaataatgtctaataaaatggataatgcattttttcttaggtatcagaaagtacatgttttatggttttcttatttcgtgggaaggaatgatacacatctaaaaatgcattagcaaccattatggcaaagtatctgtacaggttggaattatgaccccatttattttcataacagcctggatgttacatgcattttagatatgagaaaattctgaactattcccataggaggagaaatactgttagaatacaggatcattagtttctgctcctgggtctttctgggcttactatttccccaaatgtattgcttttgcttcattgcttgatttgtcggtttttctgtgtgttaagtggagaaaggggtacctttctccttagttatagatgttccatgtggtgattactcaggtagctattttattctgtgactgaaagctttatggctatgctgctttttcccttcaagggaacatttattttattcatctcagtgcattcattttattttttgcatttttgtaatttagatctgttttaaaaaatactttctcctaagatgtatcaattaagaatactttaacaagtgagatttagagtggcttaaacaatttgggatttatttggaagtttggaggtaggtagttgctggggttattttaacataacggcttaatgataaatcaagagctaaggctcttgctaaatttatgatcttaaaatagcatgttttcttttcctgtcagtatggtaaaacgacattgcctaccatcagctccagtcatcttatctgtatttattcaaagtaggaagaacagtgtggtaatgctagctgtatctccctttttaaacaggtattctagagctttcccagacagcctttttcttatatcttattagttggaattgttcatctttatctgcacagttggctgggaaagtgaatctgtgactttccagcctctatcatgagaaacagcaagagaaagaaaataaggttgaggatggctatatcagccacagattatgtgctggcattttgtgtcaccctcccctcaaccccacaacccccagactgttaaatgttacttaattgatagcttttaaaaattcttttcctagagaagtggtttagtcacaatctttaagaataggtaagggtattgaacagggaccatcttctcttctgaagactaaagaatttgacttatgaagtatgaaagacttaggttatatgtaaagaaatttcagatcatcagctctgttagaaaaatggaatgattgacagaaagattgtgtacattttggaacctctttctttggagatctgcataaaagatatgaagcacttgctgcattagatggtttagttgttgtcttgctaaaagatagacagatgattgactatttaaggccttttggttaatgtgctgccgatataacccagatttttcttttttaaatatctcacattgtgtgtttgagagctcagtgtttgggtcttaacccgatcttaacactcagcttgaacttttccttcttgagttatcagcaatttttatcccagtagtttttatttcagggaatgactcttcagtatatttctccaaaccattttaatctggctcccatagcaactgtatcagtagtggtacataccagtgggagctgaaaggcaatgttgttttatattattggtaggaaaaaaaaccacataaaaacatagctgtttcttcaggcctctgcctctattctttgaaatcataatctgaatgcctatattttcggggggcaggctgaataatagggactatcagagcatggctggattaatattaatagcacagttgttatgggctgcattcttcaggcttgatatggtgtgaagcatgtacagagttatctttttggatgagcacatcttttattattctttaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaaggtaaattataggcagttgataattttcagtagctgagatgactctgagaaggaggttgtgttaaaaaaaaaaagtgaagtcaacctgttgttctaatattttcaggttcctgtttaacttgatgtattttctcaaatggatcacttatgtgccttggtttcacgtttccttggcattgtaaaataaatgttatgtggtatgatgttcttcagttattataaattggagatctcagattactacatgggaatgtatcacagacatgctttggcgatgttttggggaccccctgtatatctggaaacataaatttactgaagatgagtccttgtagatgtacatggttaagacattgggtaaaatagttgaagagaaacaattttctagaaatctattttttcccagttgaagcagtttccctcttttaagacatacagttcattcaactttcctattcatccagtcatttgtattggttctaaatgtaacacttaaagaactgtctgttagatagcagaaagaaataacaatctttcaccttaagggttttcactccatctccccattagccagagcatgatacagctaagaagcgaatgaataaaataaactaatatactcttgggctctgttgtcttgcttagaaagaatatgtactcaggtggagagaatgttcagatgaatggggatacgccccatgatggaggtcacggaggaggaggacatggggattgtgaagaattgcagcgaactggacggtaactgacagtttcctttgccattcatgatgaggttctccttaaatgtaaatttcccttcatctatcaacatattattcactagtttgttcatctgttcagccaacaaatatttatggtatacctatttgtcacaggcactgggaatatagcagtgaattaaatgatactgtattcccataaggatcttatattgtagtgacaagacataaacagtaagtgaataagtaaatgtggtgatggttttatggggaaaattaaggcagaagtagggactttgaggatgggagtattgtattccaattttagataagagtggtcagagaaggccttacaaagaatggcaacatttgaagaaagtgctacaggaggtgggagacagaccaggtgggtgtggtgggtgtgtgggggtgggctgcaacagagtgcctggtgtgtgacagggctggcatcaaagccagcaagactagaggggaatgactgagggtgtgttagggtcagagagatggcagaggactgacagatgtaccagccttcacctcttggctttcataattccatttctcacctgtatgtgtattcaacagtgagtagcatgatataggaatgagttctcactgttctgcctccttagcctgcaattgggaattcaggtttcctaaattgcttcagctaatttctttccatgataactcttccttccctaccattagattgttccttttattgggtgttaagtaaaattttaagtgggatacttattttatgaagatatggctttttaaaaacactgcagggtttttttttaacatgaaaaggtatgtcattataatatgcaattgaatgtgaatgaaatgaagttatttcattctcctgatgacccacttggatttctctctcaaattaacaggatattattcctctgtcctttattctgaaaggatagagaacataaaatcttctctcctctcctcccctaacctttttttgaatagttttttgtaaattatttccattaggaatatccttttctttttttacagacatgagttctgggctttaatttttaatttaatcagaatatatttcattcttttatatttcacctttgctaaactaattgaatgtctgtagtatgcctggtaccatgcatagccctgtgaatactaagaaaactgaagcagggcactgagtgcggctaaggtccagtggttgtgcagacagatagatggacgatcctaataaaatgtaatagccaagagtggaaatatgaactgtaagtgcaaggtcaagacttcggagagctgttgagcttcagaatagggcattctaggcagaagccctggggaagactgaggtttgaggcttggttgggagggtgagtagactgacgtgcaagtcactcaactgacctgctgacatttgtcatgggactcagctgcatttcctcccatcacacacctccatggcttcctcccttagttccttcaggtccttaccctaaagtcaccttcttggagaccttttctggccactctatctaaaatttcaaccaccttttttccagtactacataatgctctttcccatttaatttttcttttgatttttatcactatgtgttgcatttattcatttattgtctgcctccttttcatccccagagtaaactccatgaaagcagaggttttttgatgcatgttgttcactgttatgtcctcagcactcagaagagtgccagagtgtgggcatatcgcaggtgctcagtagcatttattgaagatgaaagaatgaatgatgaataaatgagtgagtgaatggatgaatgaatgagggtggaaagggtactatggcgagatgatgaagggcctttatatgatctgcttgcatattaggacgtttttctctaggcaatgaaacattttaatgtatttacacagttcactcttttctaaagaccaactggctgatcttcaggaaatgtgacacctaatttggtgacccaaaaagaaagagatagaagaaaatttattcctttatagttttctggtttcatcgtaagtggttaagtagtatcttgtcactgattcaagcattttaaatatgttgtgtttgatttaatgagttacctcttgattaatttgatggtaatttactttacatttagtggatgtttgcattctctctgcccaggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcaggtgggtatggttttgaggaggacacaaatagtacagcccagattgccttcctcacccctacagctcagttagaagcagatggcctttcagttactcagcgtgattttctttcttttgctggatgctgcattttactttgcttctggcctgctgctgtatttccagcattttagtaattataaaaatagctcgatgaaatctggcttgagtcacaagtagggaaaggaagggaaggaaatgaggatatacaattctatttgggcaaaagcatatcagctgctttaattttgtacagtgcacaaggtttagatcttctactagtttgactatgtggaacatattctgttaaacttgatgattacactttctttgggaatgtatgattagcttaattttacacatgagcaaatagcttccaaccattgagcgatttgctcaaagttgggtttgcatgtttaccagtataatttggttttaatgaatataagctaacagttatatctcctgcaggtggacctgattctcattaagctgtaacgactctggcttgacttattttgtatgattaattgtaaccacaattagttggttacttctcagatagcattatcttccttttgcaacaataataaagttttggtgatagaaaagatgtgtctgattccctccaccaaccagaaaaatatgtcccaaattacttttagttggtccaatccttttcagaaaagctattgtgctaggtgatgaatacgagtagtgaatgaagttatattcctatgaaaaggaccagattgaagcccttttcacacttttccttccactttactatatattattgtataacctatgtggtattcataagtgatgccagccagcttattttttttttaaatgcagctgattccataggattgctgtttttctactttggttttctttcctgggcacatgcatattttagatttttgtctaaatacaaaaatactatggagattataacatctatgttgacctaagtaaaaagggagaaattatacaattgtattttagtttgtcaagtgcagttttatcttttagttcttatctagtactgcatagcatgttaccccaaaacttagaggcttgaaacaaccattttattactctctttcatggctggatggtgggttggctcagctgagtggttctctctttggtccctcattcacttgcagtcagatggcagcagaggttgaggtcacgcagcagcttctttactcatgtgttggtgcctaagctaggatgtccagaatatttggggtctggatactctccacacgacttctccacatagctaacttgggctttctcacagtggggggactgtgatgacgtctaagagctcatgctccatcagaaagaggcagttgccactcagctttgctttttcccacataaatgtgtacgcagtattgcttcattttctgatcttcaaagagaggctgaaaattctgattcttagtgaaaccagtgatttttaaatattggcaactgattaacattttaggaaataatatcgtgctggtcaaagaacacatacctctgtgttaccagtgagagatctgcagcatgggttatgagaaccaactctaataggacatagagatgaaatagacagagcatgtttttctccttttccctcatttgtaagacaaaactgaatacattaaattgtagtagtgatgtcagtaatagaatttttataaaatttgatctatatccaagttgggcagctattcttcatctaaatgacagcgtaaggataactaaaacagatcgttcaagaaaaaaaatggagaagatggcactggggaaacaccctacggccagcttgaagaagttaatacaggcaaccacatgttaagaaaatagaagaaagctgtgattttgagagggcggtaagaacaaaactgtcttccgtctgtcagaatgtatagagactttcttgtgttgtgcagataatttttaaactttttttgatggacattctcattgagatggggacattgcaatattgcctatgtgtattagtttattgccttttttgaattgaattgtaattctttgcaacctcataagacttggctttacaatgctgcatctgactgtagagaagaagtctgttcagatctgttttgatccctcctagatggatgaacttctttatgagtaggttttgggaaagtagagcactctattatgtaacatacatagttaattggtatttttctcctatgtgatatatgacctgggaaaggccttgctggtggaattagctattttctgtgttctaaagatttcaagaggaacgtaaatactttcagtgcttcaggatgttaagtagtccactaaaataaccatttgctggatgtgactcctaagagctgactttcaaatttatggggaaattttccagatgtaatttgattattttattaatagattttttaacctccattgataatttcactgaaactgtggatggattgtttgaaaatactgaagaacatgtttttcactctcttccaaagcttttttcctttaagaaacatattggcaatatctttctcctagaatacaattttgatacatctagaaattacagtaagtggcaaaaacactgaaaaagaggcatagaaaattaatgactatgaatttaaatttgttgaaccaaaacttaacaaatattaatagttttatatattttaaggactagggagtaaggtgatttaatgtggaatttaaggtggaagataatctcttgattgaaagggtatgtactttaccgcacaaaatttttgattttctggcaggagaagtcttcttgacctgggaccaggataaggaaatattttgtaaatttggtgctaaggcccaggtcattttacaggtctatggcagaagttgattcattccttgcaaatatttatggagtgtctactatgtgtttgacactgttttaagtgctggagataaagatagatgagcaaaatagacaggaattccaattttgaatcccagttatagtgtagggtattgatgaaaacagtctttttcagtcacccccaagagataccagtagtggggtgtagtgggcttatttaggggatgaagtcctctggcttcacttgcttttctaaacagtagaccaagactaagcagaaaagcattggcagagcctgaaataatctgcagttatgtcacatgccttcataaatgtggcagtgggttattcacaaaagcacaggcagctcaaatgagtcaactgagaacagtgtccttgcttttaaaggcagacagctcagagatggttcacatagggcctttattgtcaggctacaaatagacatgggtgctgggtagaaacgtgttgtgaaaacacagatgagtcactgcatggctgttgtctaagcaaactcttctgccagcttctgttcagaaggtcttgcctgtttgaagcatttatgttagagcatatatatacacatatataattagaagcagattattttgggagctatgtagattatttcccatgaaattatgttcaaaatagaacagttgaggctacagtgactctaagtacaatcatacagttataatgctgacatagatgattgcatgaattcactagcttggcgtacacattttgcccattaggctgctctgagagaactctgggacttacagaatgggtattcacaaatttcttgttaaatgtcagcagtaaactttagctacggcttctttgagtaactgaaccactcagccaagagttgacattacattcatctgagatgcaaccctggcttgtgactgtttcctttttttatggtacagcaatggaggactagaacataagctttccgaagtctgagaattatgtgacattcttattttccttttcttatagtaagttccacattaatactctggtctccttgccatattgtcaggtaaacaaaggcttttcatccttaccatcctaaataacgtgtccccttcataactaaactctctgtaaccatgcatgccaactcactacattattgcagtcattcctcgatatcagcagaggattggttccaggaccccctttcctcccatggataccaaaattcatcgatgtgcaaatctcttttacaaaatggagtactatttatgtagtacctttgcacatccatatactttaaattatctctaggttacttataatgcctaatacaatgcaaatactatgaaatacgttatactatattttaaattttgtattagcatttattgttatattgttatgttttatttttattttttcctatttttgatctgcagttggttgaatccactgatgtggaacccattcatatggatgggccaattcatttatattcttggttgccaaacaagtatactgcttaattcatgtagctacttctaattaaattgttaaatgtcagcatataaatatatttcagtagaatttattactactattggttgttcattcaaagtactgtctgaatggaacctatgcaaattaaatcaacacatatttatggattacttagtctatgggcaagatacttatataaggaataatttttgataccttgtgaaaagtcttatattatttaaaaaattgttccttttagtgttatgagatacagaaaagtattttaatttaaatctacattgttgattgtgaatgaataagcacagtctagagtgaagactgagtgaagaaagtaattttaatttttttccaggagtaaatataatcctattttcacaaaccttttagcaaaagaatacagtaagatttttagattctgtgaattttgtgatatttatggagcttaacagagcacattttaagggaacttgtctcataataaggaacatttatagttgccatctccaaatttgagactttattttaacataaagctgtgctgagaatatttaatcaatctgcttaagttggaactatatcatttcttatttacatgtgatgttccttgataagatagacaaatctttacaaagcctattatgtgtaatttataacagcaagattaaagcaaattggtaattgctttactatattgagaattgtacaagaatttcaatttagctgagtgttgtactttggcaccaaaatgcatttcctccttgaagtgaaaatataaggtgacgttaatctacactatcaacatattccagtttcaaagttaggtagagattgtctgttggaatgacacaattttggtaggtaaaaataaatagacatatttagtgacaaaataaggattctgcattacctggttgcctttaaaacttattagctatttcttctttaaagaagctttaaataatgtgctttgcttcatgggcaagttgtgaattaaatcctgtttgattgaggttaagtaatgtgtatttggtgggtttttttatttgaaagacctttgtcaccctatttccttgatgatcagaaaatgatagtgatttaggcagggatgtggggagtctcaactgatgctaaattctaattcttattttgtgtttgacttgcaactgttttgagaataagatataattatgtattgtagaaaattccaaaaatccaaaaaaattacgtagaaggtaattttgcccttaaacccatcaaccagaattgatcattattaacattgtcatgaacactttcccatacatcttaaaattcatgtgtatacagatagattgacataaaggatgctgttacataactttagtatttcatggatgtctttccacttcagtatgaatatttaacatcatttttaatgaccacatatatttatgcacatgatgcatgtgctattactataacagagcccctcttagtggacttttagtttttcccagttttttataaacaaaaaaatgtaggtgattaactacatgtttattatctgtgattaccttcctagggcaaatttctagcagaatgatagcaggatgtgctcattttattttttgatatttgtttcaaatacactacacaaggctataccagttcatatgtctaccaataacggacaaggatgtccacttgcttatacccttgtaaaaacagaattttgtcccatattctcattttttgtcgttctgtgggttgaaaaataatggttcatttttgtttaattctaatttctttgattacttagtgagggtgaatctccttttacatttttattgattgtctatacttctttatacttgtatcattggtatattttccttttggggcattagggtttttttcattgccttatgagaactctttgtataataaggatattttctctttgcttgtgagaaatattacaaaacatatttttcttagggttaccatatgtcttttaaccttatttatgatttcttttgctgtatagatcttaatttttgtgtagccaaaatcgtcaattttttaatagtttcttcttttcatgatatatttagagaggttttccctaccccaagataaaggaaatatttacccacatattttagttcttttctgttttcgtttaaattttttatccatctggaattggtttttgtgtaaggttatactggcctaatgtttccgatgatccagatacgtattcacagctcttcaaacaaaaaaaatattagaaagccctccatgtcttgctcatccagcctattagacttggaactcttggtaagatttttggctcaaacttttcttcaagcagggagataattcgtctttcaagtcttgcctctttttcatttcctgctgggcattgtaaacagaaatccttgcttatgacgacaaagtactttaggcagagcgggtggcaataaggatttggcagctgtgatctgtcaggacagaaatcactgatttattggctgtagctacacaggggaaataaaaaaatgagggttgtatatccagtctccttccccaatgtagatgaatggtctgtgtgaccaatcgttactgatattctgaaggagaaggggaggtacatctcacatttggggcacatgggaatcacttgggggacttaaaaacatactgaatccctaggcattgtcttcattggttctgatttaattgtttagggtggaaataaagaatcagtattttttttattaaaaaatcttctgagatgactctcatgtgacccaaatttgctttagatacttgaatcatttctccacttatttttgatcgtgtggtttgtcttatgctggtgacctgacatcaaaattcatataggttaattctgctctgactgcttatttccagtgacattgggctacctcataattcttgactaaactttagtttcaaaggcttatctagcaaaatttaattttattatttattattcaatatgctgcagagttccttatgaacaccaccaaaaagactggtgtttctttttgctgttataaacaaacaaaattctaaagcctgaaacacgacagtaatgttggtaaatgctttatcatttgatgccacctttatcttccatactttagtgggtggaaaattgtcaaaaaaaatagaaaattttttgttttcctaggctgttctgtcacttttctccttagccttttttccccttctgttattgtcactcagcctccctaaacaggtttataattattaatccaaataataaagtccttaataaaaaggacataaaacaacaaaagtcactttttagtgttatacgaagaaaccaaattgcgataaatccaagttgacagcatagatttttaatatttgatgtttcatcatcttgaatgtgcttgcgttgccttagccatgacaggtattggtggccttggcagcccttgccccaagttgctgaaagacataaaatgctgatattacaaattgtggttggcttttaattttttttagaatcttgctcctatggtctgatttcttttagtaaaaaatatgttttactattctgggacttgtcctaatttcttgactttaaaaaaacatgggccaaacacgggccatccttggtttaattgtataccctaatacaagctgaaaaatattcacaaatgtttttggatatcgattttgacttcactgctgtaaagtaaagcaagctattttgtttattatcattgacttgcacgtgatgcaaaggaatggaaagaagcgtctcttaatggccgtagtgttgccgcctaagacttttctgttgatttaaaatttactctgggaaatactgtagacctaaagaggcttttttttacctgtttcttctgaagactaatttttatcttttcacatcatttcttttgaatttctttttctctccttcgtctcttaaaggaaagagaaataatagagagaggctgaaaagaaggtggtgaaaagcagccaaggaaaagaaatcaacattagattgtatctctgctttatatgagactctgttcttagctctttacatattattctttcattttatccaaataattatcccgtgaagtagctattgattttacagaagagaagtaggatttagaaaggttacccagttggtcactggtagaactgagatttaaattcagatgtccctgactccaagacatgctctttgtgctgagccacctggaagagaccttagagattatccagtccaacctcctcatctttttttttttttttttttttttgaaactgtcgcctaggctggagtggagtggcgtgatctcagctcactgaaacctctgcctcctgggttcaagcaattctcctgcctcagcctcctgagtagctgggactacaggtgtgcaccaccatgcctggctaatttttgtgtttttagtagagacagagtttctccatgttggccaggctggtctcgaactcctcacctcaggtgatctgtccacctgagcctcccaaagtgctgggattacaggcgtgagccgctatgcccggctgtcatctaatatttaaataagtacagtacacatatggttgccatgtattgaaaaggtttttatcagtcagagactatgctaagcaccttacatacattatctatctaatgtgcatactaactccaggaagcataggtaggttaaataacttgcttaaagtcattgatccaggaaataatatggtatagatgtctatctgggattgtctaactccagagtccggtgctccactacagtgtctcaatttttcctctccataaaaatactgaaatttactgaggtgaagtgacatttctaagaccatcagctctctttggcagaacggagcccagactccagatttctgactgccagttgtttgctctttctactgttccacagtggtgtcacatcagaagtggaataaaatgaaagcccaaccaaaatggactagagcactttgtggcatcctattgctccacacctcagagcttagctgtctgcagcctcataaattgctagggaatatgttcctctgagaaatcaggtgtagaaatgcctttatgagttatggcttttaaaaatacacatatccacacattgttttcctttttgtatgagtgaacactgaatataataaatcagaaaagaggtttctgatagttcaccttataaattgctttaaactttacagttaaactacagttattcattacatgttattttttaaatttctgtattgtgaagaggaagatgtcaaatagttcttttctcagaaatactggaaacatctctaagtttaagcaagtttccagtgcagtgtgtataataaatcacctgtctgtgtttcaagattgtcagcaacagaatgaaaactgtagcacttaccaaaggatcaagtactgaaataaaaatatgccttttaacagtcatatggcttccataaatcaaagtggttttctggaagaaattggttgttatctttaccgaatgagcaacaatgcctgttgacctttgataagtggaacctagagtgtcatttgggtcttgcttcttggttcctttaacatttgctgagtgtctacagaccacatgtagagatggtggatagcatgatgagagaaagagaaacatggatgatgccagaagaccctgttcttatcctccccaagattaatagctatgtcaaatcaagtagagaatgcaaaaatctcttcttttgtattgctcttttcccctttatattctcccttacactcagtcagtgctgttttgatccatagtagtgataagaaatatcactctttgcttaataaagaatgttgtagtatatctgcctatcacatgcacccagagtgtagcttgtcctgccacaggaagcattcaagcttctacctttcatcttatgcatacactggtgtaagttgtaaaaaagaaagataaattataaagacatagaaagcccactgtctatgcacaagggttgaaatcctagtctgtggtacaccttttatccttaccaggggtgaagtctggttgggcaagtacatacactaaagacccaaagacttgttgtgtcacattgaatgtgaatttgttcatatcacttaactcccttgaatctcaatgtctaaatgtttcagaaatcaaggcaaatgctatttgttggcctaggataacctttttctgtcttctctgcataaatacatcttggttctgctgcccttccttgttattctggtttctgtccctgtgaggaagaatgagcaagatagtctctctacggaatggctataaataatgagatggtacccttcagccatgtgctggacctacatccatgtaaatggaagtccttatgagaccttcctgccaggcttcaaacctagatttgtgtatgaactggagttgttctggattgtttcagagtgtgtgtatttgccatgagagaagccaatcttactatttaattgtcaagtcttgttttttatccaccgtcatcccaactacattattatctagtgctgctctaaaggatttttgtttgttttctgaattgaattccacccttaaaataggaggatgtgctattgctaatgtcaatctatggagaatgttgctgtctctgaagtagtgttgtaagaaatattttgagtaattattgtaataatggtctcctaagcttttgagtggcacttactgtgtaagttttgtaagttgatttaaaaaacaatttcttcataatcattttatgtatattgtattttctttaaaaatgataagtgaatgagaagttgctggagaacttttgggacagtggtaagaggtggcctagtgaggctgacagatggataggttaactcggaggttgagggtcacaggaaatgactgagggacactgcagattccccagaaatccactctgctccagtcaaggggtcatttcaattaaaaggcttattttatgtggcataaatcatacttctaacaacatgtaatttattgtttaattgaagagagaactcttcctataccaagagatcacatgattttgctccactgttttatctaccactgcatatattattgtgtcctttaaagctatagaatttctttactcatttgaaaatgttttattttaaaagttttaatgttcagatttatagcttcatgtatgaataaagggtttctgtcatctttttatgtttaaaaatcatgtcttcataaaatattattttatgtctacaaaagaaccttcctacaaatacacatgtgcttgtctataggttggtgcaaaagtaatcgcggtttttgccattaccctaattattttaatggcaaaaaccacgataacttttgcaccaacctaactactaactaaactaataactaaagtttgaaataatgaaaaaataggaaacagcctagtttgtcatccttgaaagcattggtcctgagtgacgtgattaggaaagttaggatcgttttgtaagtcagtgatcctcgttgacacgtcacctttgtttttattattctaaaggaaaatgatgggttgatttccagagatgtaactaaaaggaaatgtggccataaaagactacttatttatgttccagcacatatattttctctagaaatagttaattgaagctcttctataagtttacattggacaatgaaaatgtaatgagaatgtcttttgaaattggtgtcttagaaattgcagaatggaggacaaatcacttttttggtcccctttgtgcccctctctatttcaaaggtgtttctctaggaaaaaaatagcttttgtacataaaagagagctactgataagtgcctactatgtgcaaggcgaaatcaggctaaacactgaaaggaaccacaaagaggaaattgccaccaaaagtaccaagtcacttctaaccatttgattctgacgtgtagaagcttcagttagtattttagtaaggatcggagccaccttttgccttctacacaccagccatcatagtaattatagtgctttagagcaggtcgacccttggagtagggaaccatgactaaattgtaggtgaaataaatgtgaaataagtggtggcaatatgcatatgggtaaaagactttgttcttcattcttgatatgtttgctaagaccctcctaatagtatattcacgtggctttatttgcctagtgacatcacaaatgagaagaaaaaagatgtgtttcatttaacatctatattttctttattttagggcgtgttggagagtttcctgggcactgctgtctctggagccatcttttgcctttttgctggtcaaccactcactattctgagcagcaccggacctgtcctagtttttgagaggcttctatttaatttcagcaagtatgtacatacatatttaattgcaaattagaattgcttaattgtagaacctttataggctagatagagcatagaatagtgattaggcagatccaagaatcactcagaatactggaatgttcagatgtgagaggtgaaagggccttagcaattaggtagtcaccacttgtttcagatgtgattcgactgaggctcttatgttgtgtgtatccttgctcccttcccacttactctctttcccattgtcctgccctgtgctctaggggctgatgcctgtggacagcaacacccatgcccctttgccttctggcttcctcttgggtttggctaatggggagtaccaacaagacgggaagagagagagagagagagagagagagagagagagggagagagagagaggtctgagtatgtctgcctttccccagctcaccgtctttgttttagcacagcattctggcagtgcttatccccgaggactttagcccctgtcaagtggctcatccaccttgactctagccctcaccaggctctggtagctctattccttccttggccttttcaagcctgaagttagtagtggcttcctgctgttgatggtccctgagtgccttgccatttgttattacttcagaatgccttctatttcctgccataatcctgactgacatgctagagaaattaaattgattaagttcacatcattcaataatgaaagagactggatgctctttacttagtccactgctcctcaccccagtttcatgttcttaactaaagatagcttccaaaactcagctgaataaatacctaacatttattgagagttgatcatgtaccaagtattatcctaggcactttacatgtactaactcatttaattcttacagcaatcctgtgaggtagggaccacatcctgatttatagatgaaataacaagcacaggaacaataagtaaattgcctaatattatatcacaagtcatcggtggggctgggatatgaattcctgctttctgactccagagtccaagtctcttcaggaatcactagaagtttctaatggacattgcaattatgatatcagcattttcttttagaaatttatggatcattttaagaaggggaaacgtgagtttccccaagtggccacattaatacacaaatagattcaaaatcaaattgggtattccagcctctttctaatgtagttgatacctctaagagagaattgcctttactggcagatctcaatccttaggtagattgaagaatgtctcatggcctgctggcactccttgttggcattcccatagtcatattgttatacatttttaggattttaattttagaactgtcattaccttcatagtacatcatggacttatggactcatatatagcctttgaaagtatgtgtgttatcaaaaatagtcataagatggaggagggaatgaggatttaaaaccagctttttgaaaacagggttgaggatatcagcaggagtcttttgagaatgtaaaaagttccaaattttaagtagtgttgtgaattttctgtaggtaattattattataaatcccttctctatcataattctcagaagaacattggaaagaattttattcatgttagtttatagaaagagtcaaacagtttttatatgtttaaggaaacattgtgtgagacaagaaagcctttgtggaaagattaaacaaggatgtactataaacaggaacaaacatgcacaaactttgcagaaagatttattggatgaaatgtgatcagagccttaatctacagaaaatgtttgcatcccagtttgttttaagtaattgtgagatacagattatttcctttcactaagcaagttcctttctcgttctcccttttttttctatcataattggtaacataacatagttccaagtgatttatttgaaaacagttgtacatcaacaagaaacatttgagaagccatgctttaaatccatcacttagtaatatgtggcaagcgttattttaatctcaatgctatatcatttgtttatgttatagcagcagcagtgataatcttctgtctagatacaaaatatttgggtagatcactatttccaaaagtgtgtttcatcaattactagactcattccatgctccatgaaaaaaaaaaacctctgtggtcccagtaagtctgggaagtgctgtatactatatacccccctcttggtagttcactttagactttagcatgcaagtgatctgaaaaagtccttcagttaagaactattttactttgtcttgcccagattttccccaacatattttaccactgttgaagaataggtagatccttgctttgtaggttcactggactcaaactctgcataatcatggatttatttctgaggttttgatatttgccctgtaaactggagaattataaaggaatatgaatgatatgctgccatctcttaaaatcagtaatagaaggaagaaaatagctcacaacttttcaaagatacttgtagttttatttcccaaattctgcaatctgttttgcattatttttacacattttatcacaataataattagattccttctttttacttgggtgaggaatctgaaagatgtttcagcaatgtgttctaaggtatataaaaacttcacaattaaggttggattttaacttgtattattatcatttggtcattcagtatttttccctatattctttaaacagtttacttttaagccttcaaatttttaattcgtccatgatattaccggatgtatttttttagggagtttatatttatttgtcagtggctgcacattaatttctgtagcatatttcagatgtgacttcttcagtttgtcttgtatccttggttttatgctactgagaaactatgactcaaaaaatctaggaacactgagtggtaccataatgatatgaatctattttttccttttaattcaccataatttcttctttgatctctaatatcatttcctgttgctttttaaaacttaattgctgtttaaatttggcaccaagggaatttattggatgtaataataccattttactgtaatcattactgatgatcaacttatttacatttttctcatcccttattcctctttcttcttgatgctctacacatatcactttcataatgaagtgccattggttttattgactttatttgggtcattcttgttgaactactgtagtattgcttaagtcttttaaagcagctagtttagcatattgtttagattctaaggtttaagtttatacatgtatcttttcctttgtacccaaactaatgttgttcctaaccattagctagttaatggatttgtttctcatcctatcctgtaaacattaaatctataaacaactactagcattcttagaacaaatcaagattgctctttcatcttcttgctagggtagcaaaactaggtaattgtttaaaatttttattttaatttaaggaaaaagtatgttgtctcagaagtaacagaactgtatttcttagttgttattctgacactgactcattgtatgataatgtaaattatatcaaatttctagaactcagttttttctatagtttacttatctcacataggcatgcataggatgaaaacagtggtgttccggacacaaagcaaactgcaaaggaaagtaaaagttatcttcagaaggatcccataaagtctattgaagataactttaccccagtattaataatctccttcttcggtaatgtatttcaatttgcatgattagataagaagagaaaaacaaaagacattgactttaatattcaccctctctagagctaaatacaaatcagatggggaatcatgctacaatttttaaaaggaaaatctaagaatcaagagatttggtttctggtcaagctctgtcaggaaaggccttaaaactctgatgttggataaatgatttaacttccattggtcttggtgtctttatctataaaatgagttgtaatttgacagattggtgtctgtattagccagtgttctccagagaaacagaacccataaaatgtgagtgtgtgtgcagatttattataaagagttggctcatgcaattatagaggctgacaaggctgacaggctggagacccaggggagccaatgctcctatttgagtctgaaggctgtctgctgtagaaccaggaagagctgatgttgtggaagttcaaaggcagtctgctggagaattctctgctgccctggggaaggtcaatcttttttgttttattcaggcttgcaactgattggatgagttcctcccacatactatggagggtgatctgctttactcaaagcccaccaatttgaatgtttatttctcaaaagacaccctaacagaaacacccagaataatgtttgaccaaatgtctgggtgcttcgtagcctggtcaggacataaaattaatcatcacagtacctaaagaactttaaattctaatattctataattttgagctatcataggaacagtcatgtcttggttgcatgagacatagttcataggtcagtgtcagtaactgtctcagccaagtcttaagttacagacatgcatttattcatcctgcaagtctttattgggcactttctatgtgccaggcactgtgctaggtaaagaatttgaattttattctaagggcaatgggaagctattgaaagatttaagctagggtgtctgactttcattaaaagggataattttggctgtggtgtggaaaatggctttgagtgaggcgagtatagatatcagtaaggatatcaatgagggggtttgtatcaggcaaaaacttacctgtgggttgggtaagattgggttggtgctggtagaggtggagagttgactgcctatgggaaagttttaagatatatcattagcagttatcagaaactcattgtctaaaagcaaggttctagagtgtcaagcatgcacaatccttgacttatttcttattctcatgcaagtaatacctactacccgctttttcgtcacaaataaatagagtttaaaaaatcattgtaaagcactctccacataattttaaagggatcagtataaaatggtaagacattaacacttgacccatcctttcagagttgtgaatcttgaactattaatcaatcagttgtaagaaatgggaaaggcctcaaaagacagtgatctccttagatagaagtagcctattctaagtctgctgtgggacaaacacagaaagatgttggtcgcaagatgcttcacacccagcttcagcagaagaatatcagatctgtgagcaagcttcataagaagtggaagggtctggcagtagcatggcaagacagcctttcttgatctgatgacagatcatatttctaattccacctcatgttggtggcacactgtccacacacagtgagcattacaggccatcttgtgccacgttatctttttaactattttttcctcttcctggccttgctctctctggtctgtccagaaagtttctactacttatccttgaacaccttgaattttttctgcgacttcatctttccttccagccagaattagttactccttcttctgtaacattatcacttagtattttatagtgcgattacatttatcgatttgtttccctcagtagaccgtgatgacatagggacagaaaatatattgatcttcatgtctttatgaacccataaaactcatacaaacgtttattgaacacattctaggtaccagtgctatgcttgcaaattgtttactctataaactctatgaaggtagggaccatattttttgaatgagaaaaataataaggttttcacatataaatgatataactactttcaatgcattttcctcaaacttttattgctattttaaaaattgtatcattaaactaaattcttaaacttagtgctttctggctaaagtagagtttcacatttagtggctaaaggtgatcttgtatttttgtcaatctttctgtagacatttggtagttttatattattctttgtgttccaaggaggaggaatctaaacatttttctttcttttttccagggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacctatcctttgctgcttctttattggtgtaggaatgtcttcctttaagtaaacctttaatacatgattttaaacttatagaagaaaaagatactaatccacttcagataatttaaagaattaaattatgaaaaaaagaaattcagattggaattgcctactggtagaattttatagtttatctctactagacaaataagaaaagaaaggaagagagaagaagaaatgaaagaaggaatgtgatgttctaggagtagatttatattgtagaatccagaaggacataacagcaaaagtaactcctggaaaggaatgtgattctctatatcttagccctttaaaatctatcataccaaacatgagttgacatcagaactttttcacaaaaaaataaaaataaaaaaatgttcagcttggtctttggaattctttcttggagtaattccattataaaattccattttataatatgaaaggcatttcaaaaaaggatttactttgagggaaattgttttagatcttctctcatagaaaaaggaatagggactgggtgtggtgtctcatgcctgtaattttgaaattaactcaaattgcagtatttgcaaggaattaaagtctgtattattctttgtacagcactttgagaggctgaggcaggtggattgcttgagcccaggagtttgagaccagtccgggcaacattatgaaaccctgtgtctacaaaaaatagaaaaaccagccgggtgtggtggcacgtacctgtagctactcaagtggctgagggagtagcaagaccctgtcaaaaaaaaaaaaaaaaagagaaagggataggcatttgtgtcagacaattacatgttagtagcactagtgattctaggttacgcaattagatacaggtctatgtcccttaaaataaaaattgatatacagtccatactttttactaaggtcttttagcaccagaagtacagcagtgttcaaagggctgggacacaaatgtggggcacattcatgcaatatccactgcgacttacagattctgaggaaaaagctcttaatgtttaccgtaaaacaaacatggttatagactagaatgcagaatgcttatgaatttaaaaaataagcaagatactactttttatgcttgtggcatgctgtttcagattgctcctagatattttggtatgcaatgcattcttctctgctacgttggtgaagaagtcttagaagactgatatgtgtcttgaattgagaaaaaagagaacactacttccctcacaataggcagtcagtaacactgatgacaagctagggcattgttgggctgtgtgctcatggattctttttgtgttaagataaattagcacacattaaaataaaacccatatttaaaagcaatgcagaaagttatataaagtagaaatttaaagattcaaactaataagaatgccatatagttatgaaagctaactagcgttcagctgtatactgatttgaaatatttgataatttaaaaagtacttggaaacaagcacaatatgtgtcattcaacccatgatatatattattattagaatcaattaaatgtgctccccagagaaacacagatgttattgtcactcaactatatggagctcttcctaggaaagaagggggataaaactcccccttcagtcagtgcttcagggaagtccagctgttcaaaatattggcttcacaaacatttaattgtgagattttcagccttcctttacatttattaatttatacataaatatatgtgtaagtttatttatttacgacttcttaggcaggtttgagtaatcatacaccaagattttctaaaggaaaaaaaacactttgagatattcatgaagccagatgtgggctttgtcaacacacctgtcacacagaaaaaaacatctaatgtcaaccccatacctacctgaggcgaatggaaacttgtgttcgttgttttataatttggatgttggcagagaaggtaacatgaaaccaaggaagacatatctaaatgtgttcaaattataaaaagtactatggttttacatgtaattttccttctaagaaggatctttgttttttttgaaaaagtgacgttaagggtggaatctattttacacttgcatagcaagtgctgacataagtggtgatagcttttcctttgtccagtttttcccaggctgtgtaaaaagtcagtgctaagtaactaggaagttgtccagaaggactctgacaattcctgctacctctagttggtaccaataaagtactgtcacaggactttgaagtcagaagatcctgtattcaagtcctggtttggctcaggccaaatgtgtgactttcagcaagttccttttcccaaggtatattagccccatcttcctaacctgtaaactaaggttaataatagtacctaccttatagatttattttgaaggaaaagaaagagctattacagataaaattcttaggacagtttctaatatgtaataagtaatcaactgttagctgccattattattgctattactgatccttaaaatttagggttagtatttagccttgaagtgtaagtaatagaataaacagacctatcttcatcatccttccttctaggcatacattgtagggcagttggcccattatgcaacaagactgttggttgtacctcttattggtactcatgaaagatatatatgtgaacatgaagaattttttaagtctatggagatgaaatctatttgtggtttggaaaaaggcagtggatagttatttgcactttcatgacaatttcatatttaacaaaaccccataagattaatgattgtgtatctcccccataaccttagtactttttgacaatgttaatacttctccataaccttactgctttttggtagcaaactgaatacattcatcatcaatttagtatttcttgatatcaaactgaaagatgatagtgagagagtaatacagttgcatatagagctcaagtaaatattctaaaaataacaaaagactggcctttcatcacaacgtgcactcttagtaaaataattcaatgagtcaataatagttaaactggcgtatgacttgtttttcaacactgggacagtatgtaacagtgaaccagcaattgcacagatggagtcgtgatcctgcaaactgagaaatgattttacaggaatggaaataggggccactaattactaaagaaacctctcttcatggccacaatatattgtggcttttttatatgtgtgtgctttgtcaaggcaacacttccttttctctttttttctttcgtcttctcacttgcttccaaaaagcctaatcatttcctaatttttcttttctaaatgcacttttttctccattcattttgctcccaactactgcttggtaacccaagtcacatacataggtttactgagcaactaaggaagcttagttgcaagtgctagtaggaaaatcagtcagaaagtttgacatatgtgagtggatacatgccatacatgggtggtttttgtgctaagatttgcttttcttagaaatgggatagctattaattagtagacgaaatggatgttaaatttcccactgtactttgatgattacatagcagagtgtgtaagaaaaacgataatttagttcaaaagccaaaagtgaaaactgaaaaatatccaattgaagaataatacacaatatctaatttcatcaccaacaccccaatttagaaatgttaatgtgataaagtgtaaatactatgtgctttagagtaaacaaaactgagtttgaatttcagtgttacccagaactaggctaattacttaatctctttgtttgataaactctgaactgggttagtgattgtgcctattcttagaggttactataaaggttaaatgagatagtatatgcaaaatagtttggcacctaatggacactgagtaaaaatttgttctttttcatatttctcactatcctacaaaagatgccccagtgagtttaatcttataatagttgtattctttaaagatttcaaacatttaattttcccataaattttcctagggaaagatactaacaaggcttctactgcaagtctgccttctcccccaaaattaacaaccagtgtgctgttatagataaatatgaaacattgaagctgtatttacaaaaaaaagttaaagcttcattgcattgtagttagagtatttaatactattgcattgaatctcgaggctacaaaagtgttgtatattatacatagtcattaagaaaaaggctttaaagtctaggggcgaggtgttcaattcttctaagaggaatctctttaatttattcaaaagcataaatactagaattttggaaatagggaaaagaacatgggcatccccccaactttcacttgttttctcttctgtcctctgtccttttttacttctcattcattcatcaacaaaaattttctgagggcctgtttcactgctttttaagaattgtgcagaaaatttttgcaatctgtccatctgacagaaggctaatatccagaatctacaaaaaatttaaacaaatttacaagaaaaaaacaaacaatcccatcaaaaagtaggcaaaggatatgaacagacacttcttgaaagaaatttatgctgccaacaaacatgaaaaaaagttcattattgctggtcattggggaaatgcaaatcaaaaccacaatgagataccatttcaggccagttagaatggagatcattaaaaagtcaggaaatagatgctggagaggatgtggagaaataggaatgttttcacactgttggtgggagtgtaaattagttcaaccattgtggaagacagtgtggtgattcctcaaggatctaaaactagaaataccatttgacccagcaatcccgtgactgggtatatacccaaaggattataaatcgttctgtaaggacacatgcataagtgtctttattgcagcaatattcacaatagcaaagacttggaaccaacccaaatgcccatcaatgatagactgggtaaataaaatgtggcacatatgtaccatggaatactatgcagccataaaaaatgatgagttcatgtcctttgcagggacatggatgaagctggaaaccatcattctcagcaaactaacataggaacagaaaaccaaataccacacgttctctctcataagtgggaatttaacaatgagaacatatgggcacagggaggggaacatcacacaccggggtctgttagggggttgggggcaaggggagggagagcattaggagaaatacctaatgatgggttgatgggtacagcaaaccaccatggcacatgtatacctgtgtaaaaaacctgcacattctgcacatgtatcccagaatttaaagtataatgataataaaaagaattgtgctacttgcagtgaagtagaatacacacatatacaaacacatattataaaatgtattgttttttaaaatagtgttaattgctttttgaatgaacaaaagtgagagtttcatttaatccaaactttggaaataaatttctaatctaatacctctgttcatttgcctaatgtgtaaatcttgcagtgactatatactcaaggcacattaatattttgaaaagggtcaaagaaaattttctgaccaggtgtcagttttacatcctgagggaaaagaaactttgctaaaaataatgaactataaaagtaagaaaaatagcctcaaagggatagacactatattgttaacaaaagggatatattttattgatttattgttgactgttccaggagaacatgcttaacaatatatgtgtaagtaaggtgagtaaattctttctcaggaaccaagtgcatccctgtctatattatcttcaagtaatagttggcttttttcctggtataaaactgtaagaccaagcctggtctggaagtaaccatggcttccagttccatacctttaagtcattcacagcataaggaggcttctagatgctctaaaatagttgtcactggagtttcaacatcatttctttctacataatttttctaatatattaataagcgctgtgcaacaatatgttatagccattcaaaagaactgctggattgcatcccctgtgttcccatattatagtcaatatgtgttttttaattagaaagcccattaaaagaaaataagaaaataaaagatcatcctaacttacctcccatgaactatatcataatatatgcaattttatttttattgtgtgccattccctctttatgaggtaggtttaaatcataaactaatggtaaaacaaggaagtataagttcttctgctgtagcatccctcaggcttgcatttgtgagactcctttaccggcacagttgacattttatcatttatggtaatagtgttttggaagagacccatcattttagtttgcttttactgtcttaacctatgttttagcagtttctgcataatgcttgccggaatcagaaaatgggattgtcatcagacctggaaaattctctagttttgggttgtgtaaaagcagatttgtaaaagtttccccatggtaatgtctataacacatctccaagatgtaatgatgggtgggtatgaaagagaagtttttgtgaaattggggacaaaatatgcccatctttttttttttttttttttgaggtggggtcttactctttcacccaaactggaatgcagtggcatgatcatagctcagtgcaacttcaaactactgggctcaagtgatcctcccacctcagcctcctgagtagctaggactacaggcacatgctaccatgcccagcttaaatatattcatctcaatatctccacagtagctcagctctttaacttccagcacaccatcgtagatgaacttgtgaagagtgcctgtagattaaagagtatacaacttgaacttgcctagttgtggtgaaaatctcaatcattaagtcttgctgaaaatacttgggaaaactaaaaggataataagaaaaaaaaaaaagaaaaacttactactgattttgtctgttttaatacttaaggctgagatagtagcaaataatttccctagaagctacttctctcagttttcctttgtcttccctcaaaagccatttttaccctttgttgcctttattgacctagaaattaaaagcatacatatttaacttaatcaaaaggtactagtgtgctcaagttatccagaacccttaaataaatctgacatgaccatgtggcagagcttatttaattttatcctttatctattttctagttacttaattgccttaagatgtttcttaaatgtaatggaataaaactttaaagtttcattatcatggaaaatagtcttaaagtttttcttgttcacatcgggttaatcagtgccacatagctgtaaccctaagaagccatgttgagggcacaggttcagattaggctaatatttattaagcaccatccaaatgccagacattttactaggggattttaatcaactatatcttgataacattgtatatttaaccatcacataaatcttgagagatagctgacattcatcccagggacaaggtctgctttctccaggtcacagagctaggagtaatcttagctgccatttatttagatctatcctgtgtttacaattttgcctacactgtgttattttatctgcacagtaaccttatgaggtagatggtttcaaatccagttttacaaatgaggaacatgtggtcaagaggtgtgaagtaactcctcaagattatgtggtgtgggagcctaagggcactatgctcagaaggtgctgggtccagaattcaagcccagtttttctagtacccccttctccacattgtattaggtgatacataaaagcagacagatatgaccttagtgaccagttgttgcttacacttgacctcacagtctcacgtgagtttgtagctgttcctgatggtacagttcctgctaatatgtaaagcagaggagccatggggtagttcctggggccaggtcactagaagataaaggggaagaacctttaacagtgcaacagatactcccctatgcaagaggtgtgccaacactgacacatggatgtcacctccttttttctctcacagctcccacaactgcagccatacttgatccacttgttctttctctaaatctctcattaaacatgaagaagtcagcttaaatgcctagtgttccattattggaatgctaagcttgtgggagttatttatatcctactgctcaaggtcatcgccaaggtctgatttttcacacacaaaaaatttttggaataaataggctaagaaggaaaagtcacagatacatttgtaaatgtcaattacttacaatattcattccctcattccagaaaatcagctaaaatctgatacatgggaaggaggaaagagatatgaaaatccaagtatggaaaacgatcaacctgtggaagctctctgaaagccagtatgaaacagagattgtcccagtggtaattggctacatctaagttagccagattcctagggcaaagggtttctttgcctcatgagccaggatgctgagtaaatgggagagacagtgtagagtgttttggcttttccatttgacttttccagaatcctaattaaggagattgcagattccatataaatggatcattctgcaattggttgccaaaatatttgcacctggatccaaatggtaaccaacggttcttgtagaccaagcttccaattgggattgatcattttcttttctgtgagcctaaagaaatttacttttaatcttgtttatggactctaacataccctgccaatatgcaattatgaaactgctttttaaatgtatttattttcaagtctttcttctgaagcagatacttattaaaataagtatggaaagtgttatatactttttactgtccttttgatgctggtcttttgggattttgagagccaatgtgctttaatagcttgtcttaggggaaaaaaattgaaattctaaaaggaatttaaatgagcagaattgatgcttatccaaaacttgagagcagctactaaaagttcagattgcaatcctattttagtacacccctggcctttattatccatcattcatttcatgaagaaagagccttgaatatctttcctcctcagtctttactccttgtttttatgcagaaaagtgtgttgcaaaaagaccttcaaactctcgtgacaggaagctgataaaattgcattaaagaatctagctcaagaagggaagcttctcaacactatccaaatagtatctgtaatttcatatatgttgcctttcctcaaaagctcagacagatcagacatttcagatcacagttgagagtcacatcatctaacattggcaagtactatctcatcttgaattctgtggccacataagtcatctgattttgatggttagaaatgctgtgtaagacaagaaagaatgctgaacaaggtcttgctaccaactctgcttctgataaactataaccctgggcaagtaactggcatagcaagcttcagagtcccatccaatatgaaatgggtataaaagtatacccattatatgctctaggatgttttaaaatgaagaaatacagtgtaagaaaatgttctttcagctttttagaacaacatagtaatataaacctagattttgttaataattatttactaacatcttcttccttttgagaatggattcattcggctttattgtttagaccaaatgtcctttagcctgtttttgtttttgtaactttcatttaagttcgggatacatgtgcaggtttgttacatagctatatgtgtgccatggggggttgttttaaagattatttcatcacccaagtattaagccaagtacccattagttgtttttcctgatcctcttcctcctcccactctccaccctctaataggccccagagtgtgttgttctcctttatgtgtccatgtgttctcatcatttagctctcattcataagtgagaacatgcaatatttggttttctgttcctgcattcgtttgctaaggataatggcctccagttccatccatatccctgcaaagggcatgatctcgttccttttatggctgcatagtattccatggtgtatatgtaccacctcttctttatccagcctatcattgatgggcagttaagttgattctatgtttttgctgttgtggatagtgctacagtgaacataggtgtacatgtgtctttgaaatagaacaatttgtattccattgggtatatacccagtaatgggatggctgagtcaaatgttatttgtgtctctaggtctttgaggaatcaccacactgttttccacaatggttgaactaatttacactcccaccaacagtgtataagtgttcctttttctctacaacctcaccagcatctgttattttttgacattttagtaatagccattctgactggtgtgaatagtatctcactgtggttttgatttgcatttctctaatgatcattgatgttgagctttttttttcatatgattattggctgcatgtatgtcttcttttgcaaagtgtctgttcatgtccttagcccactttttaatagggctggttttttttcttgtaaatttgcttaagttccttatagatactggatattaggcctttgtcagatgcatagtttgcaaaaatttccttccatacagtaggttgtttgtttactctgttgatagtttattttgctgtgcagaagcgctttagtttaattaaattccatttgtcaatttttgcttttgttgcaattgcttttggcatctttgtcatgaaatcttttcccatggctgtgtcctgaatggtattgcctacgttgtcttctagggtttttatagtcttgggttttgcatttaagtatttaatccatcttgagttaatttttttatgttgcataaggaagaggtccagtttcaattttctgcttatgatcagccagttatcccagtactacttattgaatagggaatcctattgcttctttttgtcaggtttgttgaagatcagatagttgtagatgtgcagtcttatttctggattctctattctgatccataggtctatgtgtcagtttttgtaccagtaccattctgtttttgttactagagccaggtagtatagtttgaagttgggtaacatgatgccttcagccttgttctttttggctatttgggctcttttttgtttcatataaattttaaaatagttttttctacttccacattgagaagaatctcagtggtggttcaataggaataacagtgaatatatgaattactttgggcattatggccattttaacaatattgattcgtcttatccatgagtgtagaatgtttttctattgtttgtgtcatttctgttttctttagcagtggtttgtggttctccttgtagagatctttcaccttcctggttagctgtattccctaggcatttattctttttgtggcaattgtgaatgggagtttgttcctgattgttgttaatatttaggaatgctagtgatttttgcacattggttttgtatcctgggactttgctgaagttatttttcagcttaagaagcttttgggctgagactgtggggttttctagatgcaggatcatgttgtctgcaaacagggatagtttgacttcctctcttcctatttggatgccctttatttctttctcttgcctgattgccctggccattacttccaatactatgttgaataggagtggtgagagagggcatccttgtcttgcacaagttttcaatgcttccaagttttgcccattcaatatgatgttggctgtgggtttgtcatatatgtctcttattattttgaagtatgttccttcaacacctagtttgttgagagttttttttaacatgaatggatgttgaattttatccaaagactttcctgcatctattgagataatctggtatttttttctttagttctgcttatgtgatgaatcacatttattgatttgcatatgttgaaccaaccttgcataccagggataaagcctacttgatcgtggtggattagctttctgatgtgcttcagcctattttaattccctctgtgatctgtaatgaaacagaataagaacacagataataatgcacatgtacttgctttactgctgaaatagagaaactctggcaacagctagctttagtttaacagttttacaatctaaagtcttgaaagaccagagtgaattccaaaattgaccaaaagtagggctcaagctaaatattttatctcttttagttgtttttcttgttttttttcttccccaatttatctgctctcattcatttttagtcatgaaatgccctcttttctaacttcctttattgacagtaaacaaatatttttgagttcctgttaagagctacactgggtagattttagggaaaaacagtgaatgagataagcttcttctgtccctcccttatggatctcatactctaatgtcagctatcaaaacctgtgtgtttcttcttaaaggtttatataggcaggacttgaagcatggcaaactaaaaaggcaagctagtggctcagagggactggagtagggatcaaacagtagctagcaattcagatgttaaataaactatgggaccctaaacaaacaaacaaataattaaaaaccctgatgtgttgttttataatatttctataaattaggaatatgctctaatagtttattttataatacataaagctttgcaaaataggaaaaaggcttatctgataaagaaaaatattttatagaatactttttaaatactgttttttaattttcagacacataaaattttaaaaaaggaatgaaacatttccaagaggaacgttggtttaataaattaggttcttcttcaagtgccatcttcaacctataaatgacgccacattatatgaaaataatttttaaaattagattaaatgttcatctccattatatttttattatttaatactgtctcttgttttcacacattttgcaaagataacctttctcatacactgttgaaatttccaaaagctacaaattatttaagtcttaattagtaaagcttcaatatgggaaattttcctgtacattctgaagccagtggtcaacttaatcaattatgaacagcccttgttccactagcaaaatatattgagtaccttgtagtatcagggaagttttatttcttttttttttgaaacctgaaacaaattttaataccgtctctttaaatattcaccatcatttcttatcagattagagcacagcagatgtgtccaaatctttgttttatctaggtgaaaggtgaacacatttataataaataaaaattcattgtgcccttatgttgttattaaagacatttttactgtataaccctgcttttaaaaatacctaattatgcatttaaggtctttttctattttagttttatagtataaaataattatcttttgcttacagctaatatctcaatatctaatgacaccacactggccccagagtatttgccaactatgtcttctactgacatggtaagtgacttactattttaaattaccttcatactgactgcatattgtatacttgtttataatacttataatatatgatgtcttctaccactcagcaattctggcatgaacacatacgtaacaattattgacagtggagggacgggaaaaaaaaaagccactttcctttgctctagtcagcactttttttttatttgccttaaaaaaagctgaagccaatatttacttctataacatgctttttaaaacttcttagaatttaactgccacattgcattaattgtaacctcgaaatattttcacaagggaaaatgtgagaagttggaaaatgagagcacagtatcctctctctgtttctcgtatggttaagaattcttaccaaccaaatggtgctgtgttctcttcactaagagtgattgtagcaggacctttcccctgtcacttagaacggactgtgcctctgtcacatgatatcctttcccatggctggtaaccaaggatctttaggagactggaactaagctttaaaaatgagctgttttgcatggaaggtcacacactggaaggaggcttttgtattggagaaaaaggggaaagtgctgtttcagacttccaattgtgctccttctatgctgaacatggaatcttaccaaagaatatcaatctttcagttataaagacagaagccataataccttgtgttgatagagtgcccatctctcaggagacccggacatttctacagatattatgtagtgagtgccctaacatccctttcaaagatgatgttttgtatctttcctgggcaactctcacgtgaccctcttttttgtttttatattctgtggctctcttgactgctttttttgctgttaaagtcttctctgacttttctcaaacttacttctctatttcttccatgtttgatgttaggtgtgtgaaaaagtatgtgtatatgttttaccacatgcatacagaaaggagttcaactttcagtctttcaactggtcagcctattgcctaaaaggtcttgcctaaatacaggcaaaactgcctccttctagatttgaaagaattttattcaaaattcttatagtaaaaatataattaataaactataatttaataatatatattttaattaaaatatagctaatatagttaataaaaacataagttaatttgtaataaatattagtgaaacactcacttccactgacttaagaaaagaaattgttatctaacttaattctttttgtaactaatcaagggaatcattaaaattaatgaacttttaagccctgtcgttgggaagtcctggcagaaactccagcaattgatatgtattaaaacaaaatgttacaataaggttcttgaaaaaaaatggaagttctgattgacttctagtgtgactgtgatagagacatagaggcataatgtcatttcaacttagctactatttatagaacacctactagagaccacatgtgttacacatattctcatcattgtagaccttaatatgtactataaccatcaacataaactaccagggttaattacttctattttatacatgagagaaactgaagctccagagggtaaatcacctttcttgctttaggtcacatagccatatattagtagaacaaagatttgaagtgaagtctgggtggttcttagactggtgccattcctcgtataccatgatgcttcaatgtacacaaatggcaatgtttacccttccagttcctatagatgccccatattccagggcagcaatcccttcatatgcatcaattgcataccttaattaaaatgtgaaggtgctatgttcagcacctctagggaaagaagttagaagaaaaaatgtgtgtgtgtgtgtgtgtgtgtgtgtgtgtgtgtgtgtggtcatgaaggccaacttttattttatccttcatttctcctttttcatttatatcattacccgtatttatatgttgtgtatacacacacatacaatataggtaaatgactcagaaatgagttttaaatatgatttattaccatcaatcataatgatcaattattgaggcacctactaggtgccagactcttcacagtaattgtctataattctcacaatcactttatgagttattagatgttacccctattttatagatgaaacagagacttagaaaagttaactgacctcccaaagaccatacatattacaagtacatggtaaaatgaggatttgaactcagggttttctgcctctagaatctgccttatttctgtcctttcaggaagcagcatagtgttttatgtagaggaactcacagatattgagttcttgtgtcagactgcctggttcaagtgcagggctccatgacttaataagctgtggaaccttcttagtttcccatctgcaacatcgggatggtaatagtacttatctcaaaggtactgtgagtgtcaacttaatagataggcagaacttggcataatggatggcatgtagtcatctctcagtcagtgttaggtattgttactgttctttctaggtattatcatttgattaggtcatgcagcctccataactcagaagtttaatggagagaggaaattgggaagcccatcttctgagaggctattgcgtcctccgtctgcttggttatgctagccggctctcctatcctgaacctttcctaggacacacagtcatcaggacttaattttccttttttcatttcagccataattagattgtgagagaaggtacaggaaaagtgacatgcatcccctggagccagcaaggcttgctctcacaggccttcagtacatcctgtcagatgaaggaaggtcttttcccttcagcttcactagcatgaagacaagctttctttttcatggtggtagggatatgtttcagggaaaagagcaggagagaggggtattagagcatttaaacagagattagaactctaggataactatgtctcaagataaaaaggcaggttttaaaatttccatttattgttggaatggtgtctttatttcttctcactttctccaatttttctatagatttcttgcttggtatatccctttaacttgcaaaccaaattccttaaaaggttcctgtaaacctttaaaattagccacagcttgttcacactgtatctagataatgagcattaatacctgttggcttgcagtttccagctctcagagtgtgagacaccagatttcaaaatcaaatgtcagtttcttctgaagaagtgattgaaaggatcagttagtattttgtttttccacatcagattccttttttttaaattgaggcataccttaaaatacacagttctgaagtattcattgaaatgagttttgatggttgtaactactatccaaacaagatacaggacatttccatcataccagaaggtcccatggaatgctgtattttgtttgataccctagctttctttttgggggatctttctttgcccaaatactctgcccctagccttcagatggcagatacctgagccctttccaaagtggttgaatgcctcagagaagtttctctcagctctgcttctctgcctcccatcttaagaaagtggcttccttacacttaagagaggctccatgtatctaagggggaactcttttagctttcctgtccaacccccagtctttcgtgtattacccatgcacttggcaaagaccgtgagaaaatttggtgagtggatgcagacttgatctatgcctaggactcctctgaattctgctctgtcaccccagtctgcatgtagccattaaaaattcgttaaatagaaaaattagttgggcatgatggcacacacctgtagggttatagtgagctacaatcatgccactgcactccagactgagcaatagagtgagactatgtattaatatcttaaaaataagtaaataataaaataaaaaatgtttgacttttttcctcatcttaatggtgagttttttaaaactatgatttttatagggtatctagcttgctttggttgttaggatgggagtgatggcctctcacaattttctataatcccaatcacaagcagaacaaccagtttatcttgatgtcttataatggtatagacaactgtaactcaaatgcatgctgtagatgataaggtaagatttcagattactgcaaatctggctcaccactgtgggggaaaaaactctaaataagtacatcaacaacttaaccttgaggcttttattagtggtatcactctcatttatatttttaaaagcacatattttatcagtcagtactcaaaagggctacagcacgtcctcagattacaccacttcattgtaacgttgatgaaaaaaagagaaattgactctcaggctactgcctatgtggagtttgcatgttcttctcatgtctgcatgggttttcactaggcactctggtttccttccacatcccaaacacatgcatattaggttcattggcgtgtcttaatttcccagttagactgagtgtgggtgtgtgtgtgagtgcaccctgtgatgagatagtgtcctgtctagggatagttcctgacttgcaccctgagctgccgggataggctctgaccactcacaaccctgacctggaatgataataattatcttacttatttttactaatctttcttaaatgtatgtatagctcacatttattttaacatttaatattagaaatgttttgatctttatttagaagtttggtgatgtttttgtgaccaggaatatgccatagggacttaactcttgcttatagtgattagcctatggtaaaactggtggttatacattcattttgcttaaagttccagtttccatgaacctattgatgacactgaggatctactgtaatacagaacctttaattattatttttattattattattacttattatactacccagagatgctgttaatcatgggactaagaaccttcatgatgattctaggaattaacattcatttcatgggaaatggaatgtcgtattaatattcttgtgcaaagcatccttgtgattttctctcaccgagaaagtcaagtgtaaaaaccattctgtccttaaatctccttgaagattacatattcctacttttaaaagtattacgtaaaattttaaatatgcactaaaatagaataaagcagtgaagccccatatacgcatcacctagcctcaatggctttgaacattttgtccatcctgtctcatattatccctcactttttcctttagggaggatactgtggtcttttaaattttaaaataaatcctttggtatgcatactacttttcagaactgcgagcagatccactcagtataacagggtaattctcttgaaaaagatatctcaaaaaatagattgaaatctcttttcatgagatttaccacagttaagatcctcagcaacttgatcattttctttaaatcttttcccccagtacccatttacctaaacaatctgcttcagcccatctggtctatccgctgttagatccccacacaggtgagcattcagtaagtctttaaaactgaatgaagcattgtatgttcccatatcagcatctttgctcttgatgtctctctctctaatactttacttcttttttgctgccagtgcagaaagaaatgcacatctaaagtttgtcgcttttattcccttttgttacagttttgctgtccttctgctcttactcctgctgccctttgaatacgagagttctgcaaaaaccagtccctcttttagggcttagtttaaattttgttttctctgtactcaatgaagatgattattccctcttctgaccatctgatcttcataccactcatttagatacttccttttactgggttatattattagttaatatttaagttaacatactttatttctctagggaaagttttaaaagttgttgttttatttatctttattgtacctgtaaaggttacattcgttcattcatgcacttaggtctcagtgcattttctattttcctgtggccacatttttctattttctagatgtgactgttaactcaaaatattctatatctaattgaaatagttttgccagatttagcaaacaaaaataaaacatgcccagttaaagatgaattttaaataaatattgaataattttagtataaatatgtcctaaatgttacatatgaaacacttatactgaaaatactatttgttgtttacctgaaattcaaatgtaactgggcatcctacattttacccagcaactctaaattgaaagtttattttaatttaatcttgtcctccagataaaaagagtagataaattggtagatatcttccttgaatatgtcatatattccagacatgatgacagatttcgtttgttcaatcaacaatgatttcttcagtgcctaatgtatcccaaattgaattctgctactgtcttgctctgctcttttctttttttttccttattgatgcacagtccctttggtcctcaggcaccatacatttatcatttttagcttttatccatccttagtcaaaacagttactaagtcctgggacgtctctctctctgtctttctctctctctctttctccgtccctctctcttcctccctccctctctctctctcctttctccattcttgcatttcccatcaatctcttttccttttcatccccctaaccagattatttctcatccactataaacacctcaaaagtttttgccaaccccaaagaacttgccttaaccttgcaatttgcatattctaacctattcttttgttatagtatttcttgaaaaaatagtctgtaattgctgttgcaattttttcactcccacgcatttctcagctcattgtactttttttacccatcactctgatgactttttcatagtgttttgtggtatcttcacttccattgtggataccctagatgttttacactcttttttcctgcacatttttcccttgtagttttattgtcttacaactgcaatgatcagctctttcctgatgactcctaagtagatgtctctaaacttgacatctctcctagatctaggtctcagacccactagatatctctctgaatattttcaaacttacaacagtgaacattgaggaagctacaataaattgtaataaaacattacacgcatcgtaaggaaaacagataatgtgctaagagaattctaacaggcagaaaggacttctgagattgtgttcccatttgtcttgttctttgttttcttcagagacaggattttgctctgtagcccaggctggcatatagcggcacaatcatagctcactgtaacatcaaactcctgggctgaagtaatcctcctgcctcagtctccagagtagctaggaccacaggcatgcaccacttagcctggctaattaaaaaaaaaaataatggagatgaggtcttgctatgttgcccaggctagtctcaaattcctggtttcaagtgctcctcctgccttggcctccctaaatgctgggattacagatgtgagccaccatgccagtactgtcttgttcttaaagttctgatttaaccgtttaaacagtatgtatagaattttgcataggaaataaagatcaaaaccatagagatgtgagaaccacttgtaagggctagagggcagtagcagtgagatgagttaagggtctcctgtattaaggccagaggagacaacagtggcttgaacatcaggtgtagcagtggtcataggtaagtttgttggtgaaatggaccctgcctgaagttttatggaattaaccttcactgacatcagcttatatggaacaataatattgaaataatacagataatatagatgtgttttcagtgatatctaaatagaattgtttattagctagaatttaagttttatgggagtaggaaactttgtattctgaaatgccaaatatgctgagatatgtgcatgccacctacagtttttatactgaagtccttaatgaaaggtggtatttggagactcaagtttctggatagtgatacaaagaatcatttgaggcttacaaaatagtgatcatttggcattttaagttgatgtaagcaagaagacatgtctgtcatttcatgtacatctgtatagtcttcacctcaacctgaatctctgtaagaaaatcaatagaacttcctgtcaggattgctttaatgcaacttatctgtgggcaactctagttatagagaagaattctgctggtattaaagtgctgaagtgaaattatgttaaatttttgctgattttaaaacaaagaaacctgttagctattatgacttctaaactttaaatgtatgctgctgtaaacatccatatgcagaaacctcaaaaacaaaatgagatatgattaatcacctttcagaagcagagtttgataaaagcaagaatgcagttcagctgtttacaagttgaagcttctataggaaaaatatttcagggaaagatatatagtttgttttttattgacttatgtaagcactttaccttttgagctctataaaaaaatgaactctttctgggaagagattcttcttttatgactatattactcatatcatgacaattcattgaatagtaaaagacattgatgatgtgtttggtgtgaggtagaactcttgtcttcaaaggacaggagaaatttatctttccacatttatttgcaaggtgttttcaaataactcttctgatagcatatgacatatccattagccctggacctaagaggagtaagttatgggtatttagaatggttctaagctgagacacccagtcccttccacccaaccacattggcatccatttagataggtacaattttgaaaatctcttcccaggaaagagccagattgtcacagtatgcaagaaagtgttgtgcatagcaaaagaaacttaggtaaaggatatttaagaagattcaaacatcagtataagggcgatctgtgcagaaattttattaagcaaggggatgagcaaccaggagactgcttgtcacataaaatgttcaggcagagaatgaatgttcatctttcaggactattgaatactaagggtgatagatctgattaaatcatccaagtttcctccaaactctgatattttagaaaaggtttcttaggcttagaggccattaacttttggttgactggtaattcaagtaagtcggctgttatagaagcagattcagatatagggatttggggtgcgtgtgactttattgagacagtggtctcaataaaagcagattgagagaagcagtataagacagggaagtagttaaacaaggatatggtttcagctgagttttgcttcagcctgatcccatgggagctgtggagcataaattgtgcgtagagttgctctcacctggagacgaagagggtatagttttagaccccggttagtattggtcagtaatcggctatgagagggcactacattgcaggtgaggtggctcttaaatggctaatggcagttctctagagaaaaagacagctgtgaattaagagcagctagtactcagagcaactgggggatgggtgtgctggccctatctactatgctagcaaaaggattctcctatgtattagaaacaaaaaataggaacaagagtgagctgctagagggaagcacagcactgaccccacaacagccatacatgaaaactgaccatatgtttgaggccatgtaacatggagatggatattccatacacaactacatagccttaaaggcatcacagcacatacaaagaacagatgctcataatgctgacctagagtcaagaagaaaaaaatctatactttattagaatatgcaattgaaaaagcagggaccatccatatttttatactttaattgcttaaatcaccagtccctagttatttagaaaagaaacagaatagttgtgaaagtgcttggtgagtagttaacctattacaacttttagagcattaaccatagggccatcaggtagacacgtaagaagctgtgccttacaaaggtaagtactttttgaaaaagggaaccgttttagagagtcttacattttgagacttagaatattaatgtgtctcagtttactctcaggaaggtgtgcaggaaagaagtactttgtggtttctattgaacaagtgggcgattttaaggctgttgcccaaactaggtaacaaattgcatcattctcattgtattttcaacaattgccaccctcttggcccatcttatctgttattccatgaacacctcatcaagtttcaccctccagtgcttattttcaaactgttttacagaaacttttggtataattcctatagctcatcaagtatcaaaggctgctttttatatgtcaatgttctctagaaaaattttaatgtttttcttcttcagtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagtaagtacctgaactttaaatgattttcattggatttacactgtatcaacaataatacaactttacaaggtgaaaaaggcacctgtaattcaatgtgtccaatataattttgtgcgttttaaacattacacttcaatctttgttcatgtgcatacttattaacgtaagtctagtcaagctttggaaaaccttccaaggactttctcacataattctgtcatatacctctcataattctgaatgtgctgaaaggaaaaaaaatgagatgaattatatttaaaaatgcatgagtgaagaaaaataccttttaaattcattgtgtttaagtacataatcaaaaactcttcatgtttatcaggaatttccatggtgtagaatttcttcagcagctgtacatttgagtattttagtacttgaattatgggctgtgggagtaaacttaaattgtgttgttacacaagtattggtgtaagatatgactgtcatatgagccaaactttccttcccgtaatgatgaatgccgtagtacagagaaacagataattaaactgggttgtgcaaacatcctgtctcccattaaaatgcctgagtgagcttagtccaaactgtgggttcatggagatgctataagaaaagactaatatttagttaatggcattttggttttttgcctgcagaatcaaactaagataatcctttgctttacagttcagttcttagtgtttaggatgtcagtatttcttaggcaatcttgattacacctgatttatatcagtgacctgctctgtacagctgacatctcatgaaacagctcttcttgcattatatgtaaaaggaatggaagaattttaaaatatgagatgcacttgatgaaattcctttttccaaattctaggaaatgaaaatatatttactttcacctagaaaatttttgactctctgattcttcttacaaaattgaaaataaacagaagggttgataatgaaatgtctagaagtagatagcccaaggaatgaaaaatttccacaaagtgaaatttagaaagaagcattcaacttagtctgcttaacatgggcattacaagctggtgatccacaggcagaaagaattcaacccacagccattctttgtttagcccacagtgtgtatacatacaaaaaaacacactctctctctcttacttgagacttttggtagaatctgtactttgcagatagttactgttttcccagctctgtgttgtctaagaattggctgtttcatgcattcagattaactgcctgttcttaaagacactgggaaatgtgctttcttgatacacctcttcaactgtgtgggttttgtgtagaacagattcctgggtaaaagtctttgaggacaattttttttttctcttgaggtttttccttcttaataagtaatttattgggcatcttggattttgtttgtttgtatttttggcttatactttgtaaatcatcaccacctgccaaagtctgatataatttaagtatagtaagtagaaaagtggaaaatttgtgaagcacttataagtcataatttgcaaaataaactagtttcaactttgagatgaatggagatcctttttctaaattttaaaatcttaattgaccaataataatgtaaactatatatttctggagtacaatgtgacatatgtatatgttgtggaatgattaaatcaagctaattaacatatccattacctcacatacttattttttgtgatgagaacatttaaaacctactcttttagcaattttaaaatatacaacacattattattagctatagtcatcatgctgtgcagtggatctcaaagacatattcctcttgtctgatactttgtacgctttgaccaatatcctcccattccccgcctccagtaggcaccattctactgtctacttatatgagtttgacattttaggtttcacgtgtaagtgagatcatgtagtatctgtctgtctgtgcttggctcatttcacttaacataatgtcttccagataacataatgttatccaaattattgctaatgacagaatttcctttgttttatggctggatagtattccactgtttatatgtgccacattttctttattcatctgttgatgaacacttaggctgattccatatcttggccattgcgaataatgctacaaagaacatgagagtgttgacatctctttgagatcatgatttcatttcttttggatacatacacagaagtagggttgctggatcatatagtagttctggtttttattttttgggggaaactttcatactgttttctgtaatggctgttctaatttacattcccaccaacggtgtacaagggttaccttttctccacatcatcaccaacacttatcttttgtctttttgataataaccatcccaacaggtgtgaggtcatatctcattgtggatgtaatttgtagttccctgatacttcatgatgttgagcattttttcatttatcttttggccatttatgtttcttcttttgcaaaacatctattcaggtcctctgtctatttattaggtgaattgctgttcagttttagtttgatgcaatcctgtttgtctatgtttgcttttgttgtcaaaaaataaccttatgttgaagtgtaatgataggttatttgatattaacaataatctttgcccagactaatgtcatggagcttttcctttatgttttcttttaataattttacagtttcaggtcttatatttaagtctttaatccctggctattttcttttttttgtatttttagtagagacaggatttcaccatcttggccaggctggtcttgaactcctgacctcgtgacccactcgccttggcctcccaaagtgccgggattacaggtgtgagccaccctgcgtggccttaatccattttgaattgattattgtatatggtatgagatgagggtctaatttcattattctgcatgttgatatctagttcacctagcactatttattgaagagattgctgttaccccattgtgtgttcttggcatctttgttgaaaatcagttggccataaatgcatggatttattcctggactctgttctatcccattggtctagatgtctgtttttctaccagtaccatcctgttttgattactatagttttgtagtagattagtgtgatgcttccagctttcctctttttgctcaagattggtttggctatttggggtcttttgtgatttgatacaaattttaggattactttttctatttgtgtaaaacatatcattggaatttggatagggtttgctttgcatcagtagattgctttggtagtatggactttttaataataccaattcttcaaattcatgaatacaggatatctttccatttactcctgtcttcttcaatatctttcatcaattctttataatttttgaagtatagcacattcacctccctggttaaatttattcttaaatgttttattcttttgtagctattgtaagtgggattgtgatttttttttcagataggttgttgttggtctatagaaacactactgaattgtatgttgattttatattctgcaactttacttaatttttttattacttctaaaatttttttggtggagtctttatgtaagatcatgttgtctgctaacagagacaatttaacttcttcctttccttcctttcataggttatatgtgtctaggaatttacccatttcttctaggttatttagtttgttgttgtataattgttcataagtatctcttagagttttttttatttccttgttatcaggtgtaatgtctctttttaatcactgaatttatttatttcagtcttcttttttttttagcctagatattggattgttggttttgcttattatttatttatttttatttttaatttaattaattagttaatattttttgtttgtttgtttgttttgagacagagtccctctctgtcacccaggctggagtgcagtggtgccatctcagctcactgcaacctctgcctccctggttcaagcgattctcctgcctcagcctcccaggtagctgggactacaggggcgtgccaccatgggacctggctaattttttgtatttttagtagagatggggtttcaccataatagccagatggtctcgatctcctgaccttgtgatccccctgcctaggcctctcaaagtgctgggattacaggcgtgaaccaccatgcctggcctattttattttatttttgagatggagtcttgctctgttgcccaggctagagagcagtggtgccatctcagctcactgtaacctcagcctcctgggttcaagggattcttgtgcctcaacctcctgagtaactgggattacaggcgcttgccaccgcgcccactaatttttgtattttttgtggagacgaggtttcactatgttgaccagactcatcttgaactgttgatctcaagtgatccaccagcctcggcctcccaaagtgttgggattactggcgagagccactgcaccccggctgattttgtttatctttaaagaaacctcaacttttagttttgttaatttttttaacttgtcttagtctttatttcttctttgagttttattatttccttctttctaacaattttgagtttagtttgtttttgtctttctagctccttgacatgcttcctcaggctgtttattagaaatcttctttcgatgtagtcatttattgctataaatttcactcttagaactgcttttgttgtgtcccatgggttttggtatgatatatttccattctcatttgtctcaaatttattaatttcatttttaatttgtttacttacacattggttatttagtagcatacatattcaggagcataaacttccatgtgtttgtaaaggtttcaaagttttccttattgttgatttatagttttatattgtggtcagaaaagatacttgatatgatctctgttttcttaaattttctaagactagttttgtagcctagcatatgatctgtcctggagaatgttacaaatgcagttgagaagaatgtgtattctgtagcagttggatggaatattctgtaaaggtctgttaggtccatttgatgtatggtgcaactgaagtccaatgttccttgttgattttctgtatagatgatctgtccattgttgaaaatggggtattgaaattcactattattgtattgtcttctgtttctccctttagatagaataataatatttgctttatatgtttgggtactctgtgattaggtgcatatagatttataattgttttattgaatcgattcttttattattatataatgaccttctttgtcactttttacagttttcgacttaagtatattttatatggatacctctgatcacttttggtttccatttgcatggagtatctttttccatcctttcattttcagtctgttgtccttaatagtgaggggatctctagtaggcaaactatagtttggtctttttttttttttgtccattcattccctctgtatcttttcattggagaacttaatttcatttacattcaaggattttattgataggtaaggacttactcctatcattttgttaattgtactttaattattttaatatccttcattcttttcttcctctcttgtttacctctgtggtttggtgctaagctttgtttcttttccctttctcatgtgtttatcagctgtaatttctatctttgtggttgccatggggctaacataatgagtcttgtaattataatactctattttaagctgataacaacttaactttggtcacgttaaaatactttagacttttttgctccctcccacaatttatatgtttgttaccttaatttactttcttatctactgtgtgtttcttagtcactaattatggcttttcttgttttcgaccattttaagtttaaaccttcatactagagattgaaagatttatgtagcaccattataattctgtgtttgattatgaatttacctctactggtgagttttatactttcatgtattttcatgataataaatatcatccttttgtttacagttgtagctcttaagcattttttataagactgatctagcaataatgaattccctcagcttttgcttgtctggaaagatctttattatagctttgctggatgtggtattggctaacagttggtttttgtttccacactttgaatatattatcccattctctcctgactggcaagatttctgctgagaaatctgttaatttcctaatggagattctcttatatgtgacttgatgcttttctcttgcagcttatagaattctctctttgtctttagcttttgacagtttgagtattaatatgccttggagaacattgtttagggttcagtccagttgggaacttttgagcttcttggatcaggacatccatatttctcccaagactttgaggttttcagtcattattttgttaaataggttttctgttattttatttgtctcttctttcactgtcacacatataatgcaaagatttattcacttaattcttatttattttttcctctgacttgattgggttaattcaaaagatgacttcaagttcaggaactctttcatcttcttgatctagtctgttcttgatgctatcagttgttttttttatttctttcactaaattcttcactgccaagatttctgtttgattcttttttatgatatctttcacttttttgaatttttcattcagatcatgaattatttttctgatttcactgaattgtttgtattctatagtatctctctgagcttctttaagatcattattttgaattccttttgatctattctataaatattctttttttggacctcctactgaagacttattgtgtttcatgggggggggggtgttattattatttttcttttttgctttttttgtattttttttaaatatccaacctctattctaattcagggtacatatacaggatgtgcaggtttgttacataggtaaatttgtgccatggtggtttgctgcacagatcattccatcacccaagtattaagcccagcatccactagcttttcttcctgattctctccctcttcccacctccccctcccaacagaccccagagtgtgttgtttttctgaatgtatccatgtgttctcatcatttaacttccacttataagtgagaacatgtggtatttggttttctgttcctgcattagtttgctagggataaatggcccctagctccatccatgtccctgcaaaggacatgatcttgttccattttatggctgcatagtatttcatggtgtatatgtaccacattgtctttatccagtctatgactgatgggcttttaggttgattccatgcctttgatattgtgaatagtgctgcagtgaatatatgtatgaatgtgtctttataattgaacaatttatattcctttgggtgtatatcctgtaatggatatataaaactttatatataaaatggatatatataaaacttaaaatatatccagtaatggatatatacccaaaggctttttctccacaactttgccagcatctgctattttttgaccttttaataatagccattctgactggtgtgagagaggatctcattgcagttttgatttgcatttctgtaatgattagtaatgttgaggtttttttttttcatatgtttgctggccacatgtatgtcttattttgagaagtgtcttttcatgtcctctgcccagtttttaatgggattttttgtttttttcttgaagttccttatagatgctggatattagacctttgtcggatacatagtctgcaaaaattttcttccattctgtaggttgtctgtttacaatgatgatcgtttcttttgctgggcagaagctctttagtttaattagattctgtttgttaatttttgcttttgttgcaattgcttttggtgtcttcatcgtgaaatctttgcccatgcctgtgtcctgaacggtattgcctagatttttttctagggtttttatggtttggggttttatgattaagtatttaatccatcttgagttaatttttgtatatggtataaggaagaggacaagtttcaattttctacatatggctagctagttctcttggcaccatttattaaatggggaattatttcaccattgtttgtttttgtcaggtttgtcgaagatcagatggttgtaggtgtgtggtcttatttcttgattttctatttagttccattggtctatgtgtctgtttttgtaccagtaccatgctgtttggtttctgtagccctgtagtttgaagtcaggtagcatgatgcctccagcattgttctttttgcttaggattgcattggctatttgggctcttttttggtttcatatgaattttaaaatagttttttctaattctgtgaagaatatcaatagtattttacctggaatagcattagatcttcaaattgttttgggcagtatggccattttaacattttaacatattgattcttcctattcatgagcatggaatgctcttccatttttttctgtcatctctgatttccttgagtggtggtttgtagttctcattgaagaggtccacttccatcattagctgtattcctaggtattttattctttttgtggcagttgtgaatgggagttcatctgtgatttggctttcgactttcctgtggttggtttaaagtaatgctagtgagttttgcacattgattttttatcctgagacttagctgaagttgcttagcagctcaagaacctttggggctgagatgatggggttttctagatacagttttatataatctgcaaactaggtagtttgactcccagtttggaaaacgcatttcaggatatcatccaggagaacttccccaacctagctagacaggccaatattcaaattttggaaatgcagagaacctcagcaagatacttcacaagaaggtcgtcctcaagacacataatcatcagattctccaaggttgaaagaaaagaaaaaatgtttagggcagccagagagaaaggcaagatcacctacaaagggaagcccatgagaccaacagtgggcctctcagtggaaatcctatgagccagaagagattgggggccaatatttaacatcttaaagaaaagaaaattgaacctagaatattgtatctcaccaaactaagcttcataagcaaaggagaaatcaaattattttcagacaagcaaatgctgaggaaattcgtcatgaccagacctgctttacaagagctcttgaaggaagcactaaatatggaaaggagaaacccttaccagccactacaaaaacacactgaagtacacagaccagtgacaccataaggcgaccacataaacaagtctgcaaaataaccagctaatatcatgatgacaggatcaaatccatacataacaattctaactttacatgtaaatgggctaaatgccccagttaaaagacacagagtggaaagctgcataacaaaccaagactcatttgtattctgtcttcaagagaccaatctcacatgcaaagacacacataggcttaaaataaaaggatggaggaaaatttaccaaacaaatggaaaacagaaaaaaagcttgggttgcaatcctagtttctgacaaaacagacttcaaaccaacaaagatgaaaaaagacaaaaggtattacataatggtaaagggttcagttcaacaagaagagctaactatcctaaatagaaatgcttccaataagggagcaccaagatttaaaaagcaagttattagagaccgtcaaagtgacttagactcccacacaataatggtgcaagactttaataccccactgacaatattatacatatcatcaagagagaaaattaacaaaggtattcaagacctgaactcagctctgcatcaggtagacttgatagatatctacagaactctctgccccaaaacaacagaatatactttcttctcatcaccacacagcacttactttaaaattgatcacataatcggaagttaaacactcttcagcagatgcaaaagaactgaaatcataacagtccctcggaccacagtgtaatcaaattagaactcaggattaagaaattcactcaaaaccataaaacatggaaattgaacaacttgctcctgaatgacttttgggaaaataatgaaattaaggcacaaatcaggaagttctttgaaactaatcagaacaaagagacaatgtaccagaatcactaggatgtagctaaaacagtgttaagagggaactttatagcactaaaagcccacatcaaaaagctagaaagatctcaagttaacaagctaacatcacagctaaaagaactggagaaccaagagcaaacaaacccgaaagctagcagaagacaagaaaaaccaagatcagagctgaactgaatgaggtagagacatgaaaaacccttcaaaagatcaacaaatccaggagctggttttttgaaaaaattaataaaatacataggccactatctagactaataaagaagataagagagaagactcaaataaacacaagcagaaatgatacagggggatatcacaactgaccccactgaaatacaaacaaccattagagaatattatcccttaatagtgtttataatataaacacctctatgcacatacactaggaagtccagaacaaatggataaattcctggacacatacaccttcccaagactgaaccaggagaaagttgaatccctgaatagaccaataatgagttctgaaattgaggcagtaataagtagcccaacaacccgaaaaagcccaggaccagatggattcacagctgaattctaccagatgtacaaagaagagctggtatcatttctactgaaactattccataaattaaaaggagagacttctccctaattgactgtatgagtccagcttcattcttataccaaaacctggcagagatacaacaaaaaatgagaagtttagccagtatccttgatgaacattgatgcaaaaatcttcaacaaaatgctggcaaaccaaatccagcagcacgtccagcttatccaccacgatcaagtaggcttcatctctgggatgcaaggttggttcaacatatacaaatcaagaaatgtgattcatcacacaaccagaactaaggaaaaaaccatgtgattatctcaagagatgcagaaaaggcctctgataaaattcaacattcgtttatgttaaaaactctcaataaactagttattaaaggaagatacctcaaaataatgacagccatgtatgacaaacccacagccaatattatactgaatgggcaaaggctgtaagcattctccttgaaaaccagtacaagacaaagatgccctgtctcaccattcttattcaacatagtattggaagttctggccagggcaatcaggcaagagaaagaaataaaggctattcaaattggaagagaggaagtcaaactagcctttttatatttcttgtgtctctatgttgatatcacacatctagtgaaatagtcattttttaaaattcatggagtatcttttgtagggagggatttttttttttctgtaaatgggtcttagggtgtcatttggtatagtatattggctttcattctgggtagactcagtagcatggttgccatacattttcttcagcttaatttttgtaagcaatctgtgattgccttagtggcctacttcatgggggtttgtgatggtggtagtgtggttttgctaggctctttagaatgcctgggccagtttcagaactgggaacatttgtgcatgatgggtcagcaggctgtgtggccagcaatctggggtttggggaccaggggtgccaccaggtagcctcttgggtaaggagcatggcagactggctagctgttcagtgactttcctgctttgcaggtcctcttgttcctcatgggtgaagatgccccatgggtttgagcaatgggttcttagttgtactgttggttctatgctttgtacacctggggttgtggtgctgcaggcacctgtgtaaacatggtgaaatgagggtgaggcctcaaggatggagagaagcagtggcttctgggtcccaggacaggattccctctaacagttagtccagtttaaagatggtgccatgccatagcaccttagtttgcagggtagagtatatacaacctgagctcctactctggggcaatgcagctgtgtaaactcctagaaactccctaatctgaattttggacttgtgaggacaggggactctcctgtagcaaggacttctggtatctctggtggctatggggatttctgggggcctccagtttgtctttttgtcataataataaatcttccttgattctgagccaatcccagcaagaagatagtgtgacgaagcagaaggatgccttttcctttgtctatcctgggctttcacactccatagggatttcactgcttctccggatctctcccaacataatttctatcactctaatgtaaatgtaattatttatttgctattttggtccctttttgtggagtggatgagtgccaggcaattctagtcggccatcttaatgaagtctgaaatgaaaatttttatgtcttcttatgaattgatccctttatcattatatgatgactttctttgtcttgtttttttttacttacaatttattttatctgatgcaaatacagacatccttgttttcttttggttgcatcctttcagttttaaactacgtgtgtcctcagaggtgaaatgagtctcttttaggcagcatatagttggatcttaaaaaaataatccattcagccattctgtctttttagtggagaatttaacccatttacattcaaggtaacttttataggtacagactttccactaccattttgttaattattttctggttaatttgtagattcttcgttctttccttcctcttttgttgttttcctttgtgattagataattttttccactgtgttttgatttcttactttttatcttttgtgtgtcttctagagatttttgctttgtggttaccatgaggcttacataaaacatcttacaattataacaggctattttaagatgataacaacttacctttcattgcataaaacaattttgtacttttactttatatctcccccaataatttttttatgttttggattttacaatgtatatcttttaatgttatatatccctgaacaaattattatagcaattatcattttaaatagttttgtctttatcctttatatcaaatatataagtaatttacaccttacaattacagtattaattttctgaacttaactatacacttacttttatcagtgagttttatactttcaaatgtttttcagttactaattagaatcctcttcttttaccctgaagaattctctttagcatttcttgtaatacaggtctggtggcagtgaacttgctcagcatttatttgtctgggaaagtatctctccttcatttttggaggatagatggtattcttttttggcaatgttttccccttatgctcttttttttgttttattttggagatttgtcttttatttttcattttttaaggtgtctttagtatttattagaatgtaaataaagctgagtgctaattttctctaaacttaaaaaatacaactttgatctgggcctttgatacttttggtctattttattttatttattgcacaaatttatggggtatgtgtgagattttgttatatgtgtataacaaaaggttataagggtattaagggtatctatcacccattttcaatacatttttgttaagtatagtcactctaaccttttatcaaacattgaatttgatccttctgtctgtatcattatacctataaccaaatttattctctgccctacccccatcacccttcccagattctgttaactgtctttccactccctacctcaatgtgatcaaattttttagcttccacatatgagtgataacatgcactatatgtctttccgtgcctgacttatttcactaaacacaatgaccttcggttttatccatgttgctgaaaatgacattatttaattctttttatggctacatagttttccattatatatgtatatgtcacattttctttatccatttatctgttgatggacacatagtttgatcccatacctttgctattgtgaatggtgctgcggtaaacacgtgagtgcagatttcctatccctttgatatagtgatttcctttccttcgggtagattcccagtactgcgtttgctggatcaagtggcaattctgttttgaggtttttgggaaatctcaatagtgtttccatagtgactgtggtagtctaccacagtctaccaaccatataaaacatttctaccaaccatataaaacatttcctctttctctgcatccttgtcaacatcttatttttggtctttttagtaatagctactctgactggggtaagatgatatctcattgtagttttgatttgcatttctctgatgattagtgatgctgagcattttttcatatacctgttggctgttactgtgtcttcttttgagaaatgtctattcgtgtcctttgcccacttaaatggaattatttgtttttcttttcttgagttaagtaccttgtatattctaaggttagtcccttgttggatgaataatttgcaaatatattttctcattccataggttgtctcttcattgtgtagattatttcttttgttgtgcagaagctttttggtttaaatcccacttgtctatttttgtttggttgccaatgaatttcagatcttaatcataaattatttgtctacaccaatgtccaggagaattttccctcggttttcttccagtatttttatagttttgggtcttacatataagtctttaatcaatgttgagttgatgtttgcatatggtgaggtaggagtccagttgtattcttctggatgtgggtatccaattttcccagcaccatttatcaaagagggtatactttacccaatgtaagttcttgtcagcttttttgaggatcagttagctgtaagtgtatctttatttctggattatctactccgttctgttggtctacgtgtctatttttatagcaatactatgctgatgtggttactacagcattgtaatatatcttgaagtcagataatgtgatgcctccagctttgttctttttgctgctcaggattgctttggctattcaggcttctttgtggttctatatgagttttattaaataggatttttttttctaattctgtgaaggtggcagtattttgaaacagatcgcattgaatctgcagactgctttgtacattatggtcattttaatggtattaatgcttctgatccatgagtgtgggaagtttttctatttgtggcctcttcatttcatcagtgttgtgcagttttctttctagagatgtttcacccccttggttaaatttattcctaggtattttattttattgtattgtatctcttgtaaatgcaattaccttttaaattattttcttggctagatcttggtgtatagaaatgcgactgggttttgtgtgttgattttgtatcctgcaactgtactaatttttttaatcaaatctaagagatttttgatagagttttggggttttattagatgtaagactgtatcgtcagcaaagaggcacaatttaacttccccttttccaatttggatgtcttttatttctttctcttacctggttgcttcagttaggacttccagactgtgttgaataggagttgtgaaagtggatatccttgtcttcttccagttcttagaggaagggctttcaacttgtcctcattcagtatgacattagtggtgggtttgttgtacaaggcctttattattttgaggtaggtatgttccttctattcctagtttattgagagtttttatcatgaaaggatgttgtattttatcatattgtttttctgcattgattgagatgactgtatgatttttgttctttatactgttgatgtgatgtcacatttattgatttgcatttattgtgctgagctatccctgcatccctgggataaatcccacttaattgtggtatattatcttgtagatgtactgttggatttgggttgctggtattttgttgagaatttctgcatctgtgcttatcagaagtattgacctgtatttgtctttttttctattcttgtctgtttttggtatcagggtgatattagcctcatagaaagtattaggggatgatatggtttggatttatgtccccacccatgtctcacgtcaaattgtaatctccagtgtcagaggtggggttggattatgggagcaaatttcccccttgctgctctcatgatagtgagttctcacaagatctggtcatttaaaaatgtgtagaacctcccccttcaccctcttcctcctgctgcagccatgtaggacatgtctgcttcccgtttgccttccattatgattgtaagtttcctgaggcctccccagccatgcttcctgtacagtctgcagaactgtgagccaattaaaattcttttctttataaattacccattctcaggtaattctttaaagtaatgcgataattgactaatacagaaaaattccctcctcttcaattgtgtggaatagtttgaggaggattggttagttctttgtttttggtagaactccacagtgaatctatctagtcctgggattttcgttattgggagacattttattactgattcaaaatcactactaatgatggatcttttgagattttctatttcttactgattcaattttaattggcatgtttccaggaatttatccatttcctctaggttttctagtttattattctatacttgttcataatagtctctcacgatctttgtatttttgttgtatgagttgtaatgtgtcctttttcatttctgattttacttggatgtcttctttctttttttcttgtttagtctagctagcagtttattggctgtgtatattttttgaagaaccaactttttgtttcattgattctttgtatttttttagtctgtatttgttagttctgctctgatctttattatttctttttttcctgatagttgtggatttggtttgttcatggttttctgtttccttgatgtgcatttttagattgttaacttgtaatctttctacttatttatttattactgtaaacttccttcttcatactgttttgctgaattccacaggtttgggtatattaggtttttattttcagttgtttcaagaatttttttgattttcatcttaatttctttgttgactcaaaggtcattcagaagcacgtttaatttctatatatttttataaatttccgaagtttatatttgtatttatttctagttttattccattgtggtctgagaatatagttgatatgattttcattttgtgaaaatttttagaaattgttggtggcctaatctatggtcagtcctggataacattccatgtgctgatgaaagaaatatatattctgcagttgttaggtagaatgttctgtaaatgtctgttaggttcatttggtctaaagttcagtttaaatcggtgtttctttgttgattttttaaatctagattatctatttaatgctgacaacggggtgttaaaatcttctactgttattgtattgcattccgtcttttcaggtctagtaatatttgctttatgaatctgggtgctccattgttgggtgcatctatttttagaattgttatatcctcttcctggattggttgctttatttcatataaaatgacttttttaaaactgttcttgactcaaagtctgttttatcttacgtaagtatagctactcttgctcacttctggttttcatttgcatggaatatctttttccatccctttagtttcagtctatatgtccttactggtaaggtgagtttcttataagtagcatatagttagatgctacttttgtaagtccagtcagcagttctatatcttttaagtgtagaatttaatctgttaatatttaaagttattatttatatgtgaggcttcatttctgtcatattactaatagttttctgttgttttgtatattctttcttcctttctttttctcttattatttgtggtttgggggatttctttttttttttttttttttttttttttttttttgagatggagtctcgctctgtcacccaggctggagtgcagtggcatgatcttggctcactgcaagctctgcctcccgggttcacgccattctcctgcctcagcctctcgagtagctgggactataggcacccgccaccacgcccggctaattttttttgtatttttagtagagatgaggtttcaccgtgttagccaggatggtctcgatctcctgatctcgtgatccacctgccttggcctcccaaagtgctgggattacaggcgtgagccaccgcgcccagccaagggatttctgttagtggtactatttgagtcctttttcttactcttttgtgtgattgcttcaccagtaatggctgtgctcccaaaatggtgccctgccatagctgctcaggtcttagtggggtgtgagtgacccagtgcaaattcccagtctggtgtactgccccactgggtttctaaaccaccacccttgctaatgtcagtgttcatgtgggtagaggagctcttctgtatttcagattgcagccgactgtgtaagggatgtggaccactgaagttctcttaattaccctttccctgcaatatggaacccctctagtctttctagccacttgctttcttccttatctgtgcctcaggtgttttctgtgagttccttcttggactcttgtggtctctcctatgtgttctattcgaggtatgtttctctagtcataattttggttcttctttctggaaagagtaggtgtctgtagtcagccatcttgcatcagaatccttcttcagctctttgaatatatcatcccagtctctcctggattgtaaagcttttggtgcaaaatacactgctagtattgttggaactctcttgtatgtgatttgcttcttttctcttgctgcttcaagattttctctttgtattatattttttgtcaatttcattatatcttgatatagtatttttatgttgaatctgattgaagacctttgaccttcctatagctagatatttatatttccctagatttgaaatattttctgctattatttctttaaataaacttcctacccctttgtctctctctttttcttcttgctctcctataacttgaatatttgttcttttgatcctgtcacataaatcttataaactttcttcattctttttattgttttttttctctactgactatatattttcaaataacttgtctttaagttcacagattcttctgcttgatcagttctgctgttgatgctctttattgcatttcttaattttcttaattatattttttggctccagaatttctatttgtttttcttttaataatttcatttaaaattttgaatgtaagtaatttcagtctctgttacatttctagttttggtcatttattgttttcttgattttgtagcatcctgtctttttagaaagtttgctgggcttccttaaaataattattttgaattcttcgatagttcatatatcttcatttttgagggatgattactggggctttattttttcctttagtggtgtcatgtttccttgattgttcttggtcttgtagctcctgatttgtttctgtgcatttgaagacatagagactaatttcagtccttgcagaatgtctttgtctggaaaagtttttcaccaatcagcctgtctagagattatggcaggttttctgttgtgttccacaggcaggcttgctgcaggacttcccagttaggctgacctggttcttgtgtaaacaggtgagtgcacctggcacctgggtccatggtttggaactggagcctaagtccttgagggcaggcctggggcctgggtccatgagggctggcctagaacttgagtctgtaggagtggtccaggagccttggttcaaggagtcttcctggcttcaggatgtagtggggtgggtgtggaccctgtgtctactagagcctggctccatgggtaccagcctagagcctgaggctggcttggtgctggggtaggtgtagagtttgggatcatagaggctggcctaatgcctgaagccaaagtgactggtctggtgcctgtggctgtgggggccagcctggaagctggttgtatgggtgcttgcctggagactaagtctgtgagggctattgtgggtcatgcaaccacagaggctgtcctgaaacatgggtctgctgaagtgggcctggatcctagatctgctggagtgtggggcttaagggtctagcctggagggtggagccacagggactgacctggtactgggcaagcctggagcctatatgcatggtacttacctggtgcctaaggccaggggtgctggcatggttctgcagcaggcctgaagtctggggctctctgggctgacctcactctacactagtctggaacctggggtgggcctggagcctgaggccacaggggctgatgtgatgctggacaggcctggagcctgtattggcagggactggtctggaggctgggtctgcagctggtgacctgaggactagggccatagagtctggcctggtgctgggggtgttcagagcctattatacctggggttaccctggacctggggctcatctggagcctagggccactgggtttggcctggcagtggggtgggcccaaagaccaagtccccagagcaggccaggagcatgggattgctgagccagcctggtgtgggggcaacccggatcagtctgtggttgatcctagagtctggggttctctaccaactagagtctggggttgtgggggcctacccttcatttgggttttaccgggacagacctggtgttggtgtccaaggcaaagactggtactcatttccctctcctctcaaacagagggtttccctctccaggatgtgttgcctgaggttgaagaaggggtaatgtggagagtgtaaaactgtccttcctaccttcttcaatgtgtcttttcttatttctatgttaatctgttcccttagctcttgtgaaagtattttaatcagtgcctagttgttcaaatttatgtttctgcagggcaatgaccattggaaagtcttagtctgccatcttgctgatatcatttcccagactaaatagaatggtcattttaactttctatgtatccaaaaccttttccttctggcagtaacacccaagttgaggataactcttcagacttaaagaaattctcccctcataagagcctaagcaggtaatttctcagtcattgataaatattgctaagaatgtcatgacaatgtaaaactagaataatgatagcattctagttacaattcttttaaagaaagttctcagcatagtttagaattgtatataccaaattataaaatacacagagaggagaaagtatgtgtgatttctaaaggtcagtgtgtaactgtgtaggttttcagtctgtcatcctcccttataccccaactcatttcacatttacagctaagtaataatatatacataaatacatatgcatacataaatgaatattaagaacatcattttttttgacagagtctcgctctgttgcctaggctggagtgcagtggcatgaccttgggtcactgtaacctccgcctcctgggttcaagcaattctcctgcatcagtctcctgagtagctgggtttacaggtgtacaccaccatgcccagcatattttgtatttttttgttgttgtttttttagtagagactgggtttcaccatgttggctaggctggtcttgagctcctgacctcaagtgatctgtccgccttgccctcccaaagtgctggtattacaggcgtgagccactgcacctggccaagaatatcatttttatctctcattcgccaaaatatgttttaatttaagctgacattttaaaatgtggtttctgtaggtaggtgcagacaggtgtatagattctaatatatattcttaaatagtgttttataattaaaacatatgcttaaacattatacataagacaggcttttatagctgtggaaacaatcaaggctatttttagttccttcctcacaccaacaattcacatgaaacctctaaagactcaaaatgctcatgttgagtgacaatgttcttgccatgcaaaatgtctcattctcctttagcttacacagtcatttctcttttgttctctcatttttaaacatttgtatgagttgttaagactttaaactactttaaaacacttagacttctcttttattagtcagatcaaccagcacaaggtcggatacagactaagtactcaatacttcttgactagtggaaaccagtcaagtacagattagtgctgcattttgtgggaagagcacaatgtgtgagaatccaggacctgtagattctagtgccagcactaccactgactaacaatgtgctctttgatagctatctacaaacttcagttacctcacctataaagggaaagtttggctagatgacaattaacagccttttgagctctagtactttataaatttaaggagttttctggctccatttcctatactcttctaggcttatagcaatgattgaaccttacaaattagcaaaaaataattatctccatcatatcacatctgccagtctctctttgtggatgattcacaattgtcatacagcaaaggcaaattcaaaacatggttgactttcttgtcaaaattgaacttactcatttctctgtatttcttttttttgggggggtggctaggggtgggagagagagacggggtttcactgtgttacctagcttgatctcaaactcctggcctcaagtgatcctcccacctcagaactcctggccttgagtgatcctcccaactcagccttccaaagtgctgggattatgggcatgagccactgcacctggtctgatcaaaattttaaagtcatatttggtgtatgagtcaggattccatcaggaagcaaaggatatgctcaagttaagataatgtgaggttttgataaaggcattatttatgacaggcatgagccaccacatctggctccttatattccttatctcagctaataacatcacctatccttagggccacccaagatcaaaatcttttttcttctcctttattttttttaaatgagatgaggtcttattcagtaacccaagctggagtgcggtggagtaatcatggcttactgcagcctcaaccacctgggatcaagcgatcctctctcctgtcttccgagtagctggaactacagtcacactccaccaggcctggaaaattttttatttttatttttgtagagatggggtgttactgtgtcgcccaggctagtcttgaactcctaggttcaaacagtcgtcctgcctcagcctcacaaagtagtgggattacagatcttagccaccacacatggtctgatcaaaattttaagtcatatttggtgtatgagtcaagatcccagcaggaagcaaatggtatgctcaaattaaggtaatttgaggatttaataaaggcactatttatgaaggtgaggttagagtatatggaaaccacagaagatgtggtgtcccagacagtgagactggggagcccatagtcgaccacacaggttaacttcctaaggcagagagtgtggtagagggggatagaggatgaatctggtgtgacaaagaaagatgtccattgcatgtggcactccaggtttttctttatcaaattaaacttatcacagtccttttctgataagtttattccactgcagtctttctcctttacacttacacttcgattccactcgttctggctcccattacctttgctgaggcccatggtcaatgacccagtctctttccatacctcacggagccactagcaatccctcagtatgaacacttaaaatgaaacagattaccttttctaccctgtctatcaggtatttaatttgtgtattagacagttctacagagccctaatgctcagtggaacatgggtcaaataccagtactccattgacagtcttttttgtattcaccatcctttttaaaggggtgtatcagtctgttatcccacactgtaactggtctgttctatcagcctcgagtctttagtcagagtctttagtcaaattctttcagcatcaagacttccattaggaatatcacagcataatctgtgattttctgtggcaggtggctcagggcattaacatgaaatgttcttccagagtcctacaccaacaaatgatcataaacatggaacaaagatgccatcacgcaccttatgtgcctatgtggtggcaaatgaaaaccatagcttaaaaatagagcaggattggggttagtagaaatcagaaagccacagatttgtggtggcaaaatgaaaaccatagtttaaaaacagcagtattgggactagtagaaatcagaaagtcacagaaccgcatgaattaggcaaaattattgatactttgatatagtcacattcagtgtggctggcatatgtaacaggcccaagaatgccattcttaaggaacttcttgattttctaattttcttccttagaatatgcattaattctaaccctcacatgaattggtgtaatcataagattatttttaatatacttccttgttgttattgtcatttaaataaacaaaatcactaaattccaggtaacatcaatagctgtaacaccttctatgctatatttagataatgcagaatgttctttgaagtgtggcgcttcagaaactttaatgaaaacataatgagcattttagttaggtgacagcatttagtttttattgatgtaagacacaggaaagtctagaattgtacaattagctgtattctagaaccatttttttaattgacattttggtctgtggccattctattaaaattgcatgtgtttaggttataaacagccctttacaagaatcagatgacatccccattctggtttcttttgctctcaaaaattatcttggtgaatggtaaaaattgtcaaactaaaacaatatattaaaacaggagtaagaaataatgggcatgtattatatgtctcactttagtgttcgccatcttgggtggcatttgtcttctttagtgacaacaaagcaaacgactctgctatcactaaaggagaaccagattttcaaattcttgaggtattttatatcaaggaaaataatttttaaagtcaaatttgtttttaatccaaaattgtttttatacttattttcttaagaatgacaaagggatatttagttataaatgcaacttagtctgttaaacatttaacaaaaactatacaaatacttcagttcttacagacatatgaccaaaaataaaaacacagtcgacctgaattgagccccaagaaaaataggttgggagcagtgattggccaaaacatttcgagaaagcttttagtggttgcaaagaggtagtctgtggatagaagtaataactttaaccatggaaacctcttggtcctgagcactttcagcttatttatccatcagagaaaagtcaacaacattgaaatccctgcactaacacaaaatggtctcctatcccattttgggattgtctaagttatacatatgactgattaattattatttttaaacttttactcttgtgtattaatataaattgtaaaaccatcttctttttaggccctggaaccctttatgatagtgatttatttgagttttatctaagataactctattagaggttcaaggaatgttgataatttggtcttaatgaattttagtgttaggactttaaacaccatctagtgtaacatcactgctgacatgtgagcttcatgctgcttgaatgcttcctagaacaggaacctagcatcctgcaggcattcttgatagaaacacaaatctacctttccgtagcctctgtccacagggtctgcacttgccatctggagctacacagaacaagttaatttctctttcctgtgatagacttcacatagttgaagacaaattctccctgcaatgtctttaggcctgccatcatttttcttgtgatgtgttttctgtattcccaaatcctccggctgaccttttctagattagctccagattttcagttttaatttagaagatagtaaccagattgagatgtagtattttccatgtggtttgatcatttgcttctggtatacacacattgggtttcttgttctactgtgttcttttgagacagaatggaagaaaaggtcttttagtgattgccaaagtctcctcagcatctttgctgaaccacttcactaggcttactctccttcctgtagacttccattgtcaagctccaagcccgacccagataaattctccagttcatctctcttctttgctcctcaaatctctttgacttagaacttatggcactaaaatcgtagagtcaaaatcagactttccttttattaaattctgattatagtgggtattattgaatcaaagtacagtgaattaggattattgctatgactactattaatgcttttttttttgcatagtgctttatagcattggctactggggggtcatatttcaaacttttagggtattttggtgcctttttgtgattaccaaaatagccataattgtctggcataatttttctttcatgtaaaataaatgcttttttacactgctgtttagcattttccaagcaccacaatcactagaggaattgacatcataagttaaaatgtactgagagcccacagggtgcctgtcgttgtccttgtctctttataacagctgtatccattgagaactgctctgtagactcatggccctttccctccagttaatttaggagcagctgcagcccttgcaaagtgaaaaccaaatgtcctctgggatttccaagaaacctaattcatttttccactgtaaattaactggcttctcactgttagtgtctctatgattgtgactctctcaataattaatacagtatcatctttcatggatattatgtttataatagatttattaagttgttttgccaaagaaggagagaacagcatatgtttatttgaatttccttttccatccacttaatttcttctttgctttggtagtttaaatatttaagctgctggcttcttattagattaattgagatactgtctaattaatcccgcagaggacagaaatattattctcctcttcatttttataattaaaaatagtaaacaaaaatgaaagagttcaaaactagtctgatataaaaaaggcattacagtcttaactgagacatgcttctctttccgtctttcataaattgaggtagaaattatatgctgtagcacatccatgtatcatttttaaaaacttttttcatggcaagctcttgctatctattaattatcttaatttgtgttctcttagattgtgataatttatattcctaagatattgaagtttgagcctggagagacttaacatttgatttggatggacaaccacaatttatgatgtttgttcaagctagatttgagggctctgaagccacaggtttgggcatgaactcttgagggaacaggttttctcatgaaaaccttggcacttctacttttaaccattaccagtaacagctgttaatagtagagaattaggaactatgactttctaatttgatatctttattgatatattgacctacatagcaggatgtttttggagtttttgaaagagatcaagtttgatgaaatgaaagggaaaacaaatgatgaaagaaaatcacatactcttcttttctaaatgcgcttaaaactgtgagaagggcccaaagagagcagttcttatctccttaaagtcggactgagaagtcttatttacagaccccattgtgtatctagtagactatgtactcattgctagacatttttagggcactttctacttctactatgtcagttttgcctagctcaaattaaagtttcattttagtatagagtaagacatgaatagcctgctaaaatagcacccctacctgtcttctctaattaggggatttagagttgaatataacagtggtctggggaaaatcaatttccttgactgtgaagtttaaactggattcaagatctcagaaatgaatatcttaataataaacactctccaggagtgatttctgctgtaattaaactaatattatacaatttaaggggaaggaagtggaaatagaagtttgtatgttatgcagactatatcaccctgactgtgatttttaatgaggttaagcaacactattaatagggtggcttttttctccataaattttaagaactgtaatcctgacatgtattaacatgagtgtttttagctacttttatgcctgtactgtaataatgccacacttgacaagtaagtgccatcacgtatatacatatgtattatgtatatacatcatattatacgtatcattaacatatctctgtttgtttatatgttattagtttctatggctgttttgtcaagtcaccacatacatggtggcttaaaacaacaaaatttatatctgagaggtcagatctggatgtcaaaattgagatctggagatcagaaatctgaaatgggcctcagtgggctaaaatcaaggtgtgggcaggactgcattccttctcgaggctctaggggagaatgtgtttctttgacttttctaccacctaggggctgcctgcattctttggctcatgactcttttcttcaactttatagccagcagtggccagtcaagtctttctcacactttattattctgacactgattctcctgcctccttctttcatttacaagaacccctgtgattacattggacccacctgtttaattcaggctaatcttcctaaactagtggattggcaacattaattttctctgcaaccttaatttgccctagccatgtaacattacatattcacaggttgtgggaattaggacgtgggcatctttaggggtatattatactttaatctgcttaccacagtatctgacttaaattttaagatgagtacactgggtgctatgttaatagtgcactgaaggggcgcaagtgcagaagcaggaagactatgtaggaagctaatgtagtaaaccatatgagataaaatggtggcttaaacagggtggtactagcaatggaggtgatgagaagtggcaggatcctagacatattttcaacataatttgctgaccaattagatgtgggatataaaagaaagaagagttgagtatattccgaagttttaggtctgagcaatggggaaaattaagctggcattaattaagatagagaaaactattcaaagagcaggtttagggtgtcagtggtggggcagtgtgggccagggaagaggagccagggggagatcaagcacttagtttttgcataagtttgagatgcctggtagtgattttagtcaagcaggtctgtcctccaccagggccagaggtataggtcctatgggaatttctgccaaagaattgcagattgaatttacttgccaccgtgtatttcccttctcctctttattaaaaaaaaaaaggaggagagctatctgccttttaaataactatttgtcttccttcagtatatataaaaaatccaagtggaggtgtcaggtagttagatagataattctggaatttggaagagtggtctagcctagaaatataaattttttgttctttagcatgtaaatggcattttaaagcatgagagtgaatgtaatcacttagggagagaatatagataggaaagaagagaccaaagtctgaactctggaacactgcaatctcaagagtttggaggagttgaaaggaaaccagcaaagaagaactagagtagccagtgaagtaggatgcaagtcaggtctgctagatctgatttccaaaatgtcttcagaatgccatagtattcttagatcagaacatggtaactggtatattacagacagttgcttttgaaaaattatattggataattggactatttccatacacatatcctgctatcagagttccttccggatccactgatagttctgcatttactctctgtccatgtaatatgaggtttttgaagtttaatgagatactcttgagaatatatgttaatgccatctttagagggtgatatatctgtgtaggctctgtattaaatatgagagttcagaatggagtaagaaattcagttgcttcattaagctacagaaattataattttaggagatttgacaattttatattcttttgaatatcctcattgttgacaaatttcttttgctttgaatggatttaactttacagagtatctgcagtaatttgtgtgttgttgaatagagcgaaaattggaaaatcaatataacattctagaaggtaattggcatcatataccaaaacacttaaatttttatatagacattgatatagtaactcttctgacaggaatttattctaaggaaacagtcttatatatatgtgcaaagattttttttatgatattgttcattatagtgaaaagttaaaaacaatctaaacagtagagtattagaaaaatagattttaggataaccattcagcataatactatggagtcaacaacgtataatattatggaaaatatcaaatgaaatagaataaaagtggaaaaatcaaaatatcaaacagtatgtgaaaaattctgtatgtacacatatatatggacataaatatgtagaaaaggatatatttgcaagtgttaaaattcatctctacatagtagaattgaaaaacattttcttttttcattattttttctaaatattctacaatgaacatatattaattttgaaacaaaaaatatatttcaaagaagatagaattatggttcttcaggcatgtgcgatagttaatgtgggtaatcaaacagtctttgctcagtactaaaactataaaaggaatttttaatttttggaacaatagcaacaccattaaaagaaatggatagcttcccaaagagaataatttgaaaaacagccctgatttggatttggaagttctgggattttgagggggtgttggggtacattttaaattgagctttaatttgcatagtaaaattcacagattatacatttgtgtaaccaacatccaaattaaaatacagctggtatatttgtctgaaaaaaaatcattgtttttctttcaacagtattataccttaaataatttcttaaagcagtatagatctttcagggcattttctctttgttggtacttggaatcatgcgtcttgatctcactatctcttggagtagtgtggccaaattagcagccccatacatgggctctcagtgatgaggttcagtttgccatgtaggttttgcagggcgtccagtttatggaaagctgagaatgcctcctctaccaactaaagaagcagaattgcccaggtgcctggtagtgactttggtcaagcaagtcagtcctccaccaggaccagaggtatatgtcctatgggaatttctaccaaagaattgcagattgaatttatttgctcccatctatttcccctctcctgtttattaaaaaaaggaggaaagctatctgccttttaaataactatttctcttctttcgaacaacttataggatatttgtgttgcccactagttgcattttctaggtgaggattgtaagggtggtaaataagaactaacttccattttgcctttgcaatgacctctggtcctccagtgatttatgacctactggtctagaggggtgtttgtaacttcctgacatactcctgaactgcttcataggaccatcttttgccagaccaccctgaactgccagtgtcaacactacttgcacaaaacttaataaatgagttttctccagtattgagcccctaagaaacatcctttttttgctgtgactccagatacttctaaccaaaattagctctgagtggcagttccatgtcattaatgggcttttaattttttatttcttggatttgaagtttcatttcaaagaccacctgacagtagatcatttagttattccagtggtctgcagccatgagaacttctagaacttgaaataacaataattaacttatattaggagagtttattatgttccaggcaatattgttaagcactttcatggcttttcttacttaattctgataacaaaccaatgaagttgtagggattattttggctatgttttgcagatgaagtaattgaagctaagaaagggtaggtatttacaaataggaaataatggtgcaggagttccaatagtggttgtgctcccaactgctgtactatattatctacccaaattgattcctgccatctattggttcttaacattattgtgtataattgatgttaagttgctcataaaaggctggccttctcttcctcagtatgtacttttcaagaaagctaaacctagcaaatctagccctccaagaaagaaaggaactccaggccaaaaggaacagctctgatcctgctgctagttagtatcaggctcctgacacctggtaaaggtcaagcattgaacactagggcttttaccttacccaccttgccaagtaattttcattcctcattttagtttctgttgactacctggctgcagtaatactattctctttcaagaaatcctttgtcttcagaggcgtgcatccactcagcccatcactgatctcccttccttcatccagcagcatcagaagctgactgctcaccctgagataacttcataacctctgactcaaccttggttttatttaggagcaggcttccttgtatataacttggctatgagcttcatgaggacatgaattgtatcggttttatttactgtggtatccttagcaccaagaaaagtattgggaactgagtaaattcttgttgaatgattaaattatgtgctaacatgtgtatgcaccgtatgggaagctcaggtatctgtgctctggtaatgcccttagtcctcattagtgccactagagactacagaacaatctcaagcaaacaaatggtatatgctccccttaccaacttgcaaatggccattattcacccacttcatgggaatggtcatagtttaatgctgtattccttaaagcccagaccttgtcctgaccagagaaatttggagagttatcagataatggcagtcacatgcaagaagtggtagaggagagatgtcccacatacgtgagactttaagtactaacctggattgagaaatattttatttgacaaaactagtgcagctgtgacatttctatctttcatcacttgacattactttgaggtcttgatatttacttcactcaagggacagaaacttctaagccctcccatgctagatttttggtgttttcaggctgtcttatgagatttatcttactctgtactcacagtgctgcctcccaaataacacacagaatttctatgttgttgtgcagatttttataatatgtacttagttttcattcttatgcaggtgaccttcatgttgcaagcaggatgagtttatacagtatctcaggggtacgttctatttgattgccctccctgcctacacacacacacacacacacacacacacacacacacacacacacacacacagaaagagagagagagagagagaaagagcgagcgcaacctgttctttgggatacattacattatctagccaggtgatgtactaatacaaaaacaattttaaaaataatttttctgcactctgatacctccttcaatttgttgatgaagctgttgctataaactattagcaaatacaaagttcttcattcagttcaaacacagacaaatatatgtatctggtgctaaatggttcctggtttcttttttatttttccaggcaagaaaactgatcagtgattttgccattatcttgtccattctcatcttttgtgtaatagatgccctagtaggcgtggacaccccaaaactaattgtgccaagtgagttcaaggtaggtgaatgtctatcttttggtcattcctggaactctttttctttctttccccctattctaatttattgtgtttctctttgagttagttttgtacaattatccatattttttttccaaaatcagtccctcttaggctcatatatacatgtagtttaatttcttcactacaattaaatgtcaagactagggtttttatttaaaacaactgataatactattataaactctggcttatagttttagaataaatatccaaaatattttatataacttattaccttgatctatataatgactctgggaaatacgtattgtaactatcatcctcctgattttttcttttttgagacagggccttgctctgttgcctaggctggagtgtggtggtgcaatctcagctcactgcaacctttgcctcctaggttcaaagaatcctcccacattagcctcccaagtagctggtgctgtaggcacataccaccacccccagctaattttttaatgttttgtagagacaaggtctcactatattacccagtctggtcatcatcctgattttataaagttaagattgaagctcaaagaattaagtaaaatgcctaagattatggaactagtaatgtcaagatgtgaagttagaacccaagcctccagaagtctagtctaatactcttttcatgctatgaaactacctaccacacgcatgtatatataatgtgaattgtaattattacaaagtagatataataattacttaacttacgaacctattgatatgtgtaggtaatggataaaatttacattccagtcattcctaaatatattcctagctaatttttcactacaagtcttttatctattttctagaataatcctccttccctccactactgagatcatatatttgctaagaattattaagctagttgcagttttagtttaataactgcttaatgaggaagggatatatatgttataacacacattattttttgaattgtctctgctatcacatattcattagtaaagataagttctcacccattcaaccattaattcatttgagttaatatttattgaatattgagtcaggctctaagctggaaatttgaaatgcattgatgagtaagacaaatttttttccctgacaagctcacatctgctaattgtagtaaaatgaggttagattcagtgacagaattatgagacagatgatgggaatgtcctcagaagagaagtgagactttcttgatagcaaatatggagaaaataattcacagtgttctattttagttttttatttgcattgttgaatgtaaggaaaagcgtaggaaacccttttttttctgtagtagacatatatgatctactgatggaaaacagactaagaactgcaaaaatgacagttttttccagtttttttttgtgattttcctaaaatttacccagttattatagatcattatttcatatgtaaaataagagaccagaatttttacattagttcacttatataaaaacagttatggctttttatatatattatgaagctgttaaaattcggcaatagtataaacaatttcattataattgctaaaacccatgaacaaaattcatggtgatttggtaatttcttgctacctttttactgaatttcttgctatctttttactttttaccttttactttttacttgctacctttttacctttttacatttggagttttcttctggctactctttaaacttaaatcagtttcttccattttgagtccttatcttaaaccatcccaaatatgcaaaatgccattcacttattttccaacagcccatactctttctctactttctttaaagaattgcctcaaaaataacatcctttgggagagttttggtgaataatcttcattctctagctcataactgtttatatttctcaatatgttggttatccaaatataaaagcatgtcttcccgttggttttttcaccaaatagtatatattaacctgataattttctgaaaaatgtcatctgtctttttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaaggtaagtgtccataataatgtctgtcattgccttctactttctttttagtacttgaaaacactaattgattaaaaaccaagggagctttgttgggagttactatagctaatgttccttaagagtccgcagaaccagagatcactttgtattggtacatgtcttcaatataacactttagggagagctcatttaaatctgaaaaaaaaaaaaggtttcaaatcatatttctttcaccagcaaagagaatacaaacataatttactatttagccacagtcatcctacatctgattttagtggagtaactatcctcaataaagacaatgacaatcaaagatttaattaatttatactgagcatctgctttctcttaaatcaactcaggtttattcttaaagattattcagatagttcatggttgtaagctggtggtgtacatcctgttttttgtcttcacatacttgtgtcagtatgttattaaccataaagaagggagaaaaatgctttattttggacattttaaaaatcagttattaactttgttatgagtctaaagaaaatgccttagtggtctgggatatctttcaagagagctgcctaaaatgctcttactttatataatgtttttccagctccagtgacttttttagttgcaatggatttttacaataccatttgaagaagtgagatatgaatggtaacaataataagagctattatttagtggagggctactatgagccaggccatcttctaagcactttgtattatatattaactcgttaacttttcataaccaccatatgagggaagcatgaaaatgcattagagtctgttacccagaaggagaggatattactaagaatagagttcaacacagtaggtatagcaggaaaaatattcaggaaatataaagaattggctgactacagaaacccattgagcagaggaatgagagagatgaggaagattctgataaactatccaagtagggagaacttaaaaagctgtagatcatggtaagaaaggagtaaatcccataataataagaccaggagaagaaaattaaaagctttggtcaaagaagagatgtttagattttgagagtttggaaggagagaaagctgagattgatgaactggtccaaagcatgtggctagctcccgaagcatgttgacaatgacgtccatcaaaacttgtaagttagagtaatgtgagtctggtgaactgaaagtatcacctgcctcaatattgatatgattggaaagtggcacagagcatggtagagaagaacatcatgggaaagttgctaaaaccataagtaaaagtatataactgtcctggaggtcggcatatttagtgatgtggaagggcagaatgaagaataactgggcttcaatacaaggcagttcataaagcacgaaaacaagtgaggtatgctcccatctaacatggagagtaaaacaaacaaacaaaacaaacaaaccaacaaaaaaactagactgtcactaaagaacaaatctctgcaagaaatcagtgctcccaaaggaaaccaagtggttttcacttatgatgaaagaaaaggttgcaaattcagttggaaaattacattaaaatgactttccccctatgcccactcctgccgtgagtagatactgtactgctctgagatacttttaattctaagatcattgagcttctcacattctggtaatgttgggttatttgcacttgttacatggcagctgacttaagaattaagaagtggaagatgctaggccattaaatggttatatctgcaactggcacagccttacttctttactttgctgtagtcaatgggtcaaaatagtcacaggggcagcctccattcaagggggtgaggggggaattctccttttaatgggggaatggcaaggtcgtattacagaaaaccgtgtaagataggagatgttttccagccatttttggaaaataaaatctgctacatttgtactgaaaaatttgccatagtctagatcttggtgattgcttccccgtggtatcatttaagcatatatacatatatacatatatacatatatatatatatatatatatgtatatatttatttatttatttatttttagacagagtcttgctctgtcacccaggctggagtgcagtggcttgatctcagctcaattcaacttctgcctccggggttcaagtgattctcctgcctcagcctcccgagtagctggaattacaggggcatgccaccatgccagctaatttttgtatttttagtagagacgggtttttgccatgttggtcaggctggtcttgaactcctgacctcgtgatccgcccaccttggcctcccaaagtgctgggattacaggcatgagccaccatgcctggcccatttaagcatattcttctgtcttctgtgcttcctttaaattggccatttgatctagaagcttgaggagatatagttttgatattgcatatctatctatctttgtgtatgtgtatatatacacacatataatatatacacacatatatgtatatatgtgtgtatatacatatcctttcttatatgtatatgtatatgtatacacacatatacatatacatatcctttcttaccacgatctacagctttttaagttctccctacttggatagtttatcagaatcttcctcatctctctcattcctctgctcaatgggtttctatagtcagccaattctttatatttcctgaatatttttcctgctatacctactgtgctgaactctattcttagtaatatcctctccttctgggtaacagactctaatgcgttttcatgcttccctcatatggtggttatgaaaaggtaatgagttaatatataatacaaatatgtctacatatatgtatatgtatacacatatgtctacatatatgtgtgtatatattatacatatatgtgtatatatacatatgtgtgtatatatacatatgtgtgtgtatatattatacatatatgtgtgtatatatacatatatgtgtgtgtgtgtgtatatatagagagagagagaaagagagagagaagcccaagactaatttataaaaggccagataactttaaactacaagtttgccttaggaatttcgaggccacagagataatgtgaattccagctctaaacccaattgtagagttgtggttaggaatatccctatcctgggagattctttctttcttttcccttcttttggcattatacccaatggcaaggctgagagaggcatgtgttcccactatctttctctgtggggtattttttttttgattggccaactgagtatgccatgtttagagtgtactcgttttattttgggtggtatctcccatctatgccctctcccacagagcccgagaattggtctctgtcccaagagttcagatggtcattctaattcaggccgtaagcctccaaggattggcacggtctctctcagggcagtcccaggctccagggcttactaactccaaggatttgcttcttcgcgtggctgttgttttttgtatccaattgttcctctttctagtggatgagccatagtttctaaaatatattttctgtgtctttttgagcattttcagatgttctgtattgagagggtttctgatgttggtttagtttaccaaaggctagaaatggttgttgactaatatttttattctgaaaaaaatttgttaacaaattcttaattatgatctacggttggctagatttatcctgtatctttggaggtaaataaatctcctactaatttttactcactatgttttcttattgataaaattcagaatttagaatttcggaagtttaggaatgataaaatacagacatttttaatcttattttcagtagaaaacattagaaaatcaaggtttattagggtttgcctcttaaaataagagttgaatatataaaaaataagttttcatcaccttcagaattgccacttgaaatcattcttttgaataatgagagttatggaataggtgtcagtcttttgtcacaaatctaatgataccagtgaacatttcatcattaatcaaaggcttttcactctgaaaattgttttgttcatattttgttaggaaaggagagctgtggaatatgaacactggagattctgtctaaaattgtaaagggccttaactgctatgaaattgtttcaaaagagaaagctgaaactgagagagatagaagcattgtggtattaaaaacagcatgtttttgggtggcatttgctttggcttccggtcaagtggctctggctgtctgttctgcttgggatgggatccacctttccactctgctgaacacctcagtattgatgtaggaacgccaagacacttggctttctttgaccattattttggttgtttatgccctgcattagccctgcagagtgctcaaaagcaagccagggtcagcaaggtcatgattcctttaaggtcattccctgagtcattggcagaagaaggaatagagtctgagcttcagactgcaaagtcagagatacttctcacaaggaaggtgatttcgagagtgttatagattgggggtaggagggagaaataatttaggatagatatctagaaatagatatgaggtggttgtggcaaccaatttgctctgatatcttttatgggaaaacccttaatttgagggtgttctttttggataactcccaaattcctatttttgccctactttcatttttcctttttatttctactctcataatcctatagactcagtccttttattttatgcctagactcttctaaagggttagccataataaccaatcttccttgcttcattccaaaagccttcattttttttttaaatgctattcttgtatgtcagtcctgtgtttttaaactttcacactttggcccctttaaatctttacctctcaaagaacttccatttgtcctagcctgggttttaagactctttgccagagtaccacgacctaagtttaaaatggctttcttcaaatgctagccagtgctctagtcaaatgaacagttgagttttccttaagcgtgacagtttcttctgctaggtactccagccagaaacctcttctccttacttcctaatgattgctatttttcaaaatcctctccatcctttaagataattcaaatacaaaaacttctcagtgtagctttcacctttaatgtaatttatatttctcttgtttttgctcttagtatatttgtattactctgtggcacagatcacatatttcttttacagtatctgttttgtataattactttatcccttttcttggccaaaatgttttcaaggtcaggaccatgttttattcctcttttcagctctcgtttggcccaccagtttcatatggtagactcaataaatacatgttgatgaattttattctctttggcccacatggctctcagttgttacactgtgtgaaatgggtgataactgcaaaacatataaactctccacttctcaaagtgtgtgcttatattggtcaaagccctgtttagatgtcatcactgcagggagtttttgtgaatttactgtagacatagttaaacacttcattatctgtactttttattatcgtttccaaacctctttgaatctctattcagagtgcattataatttgtgtacaagtctgtgtccccttcttcaattctgagccccttggtgggaggaaccatgtcatggctcttagtgtccccataaatgagcatattgtctggatctttgtgggcccctagcatgaacgtctattctgtgtccctgcatgtcccagtgtttactgctcctcacctctcctttgttatcaactatgtaccacatgtaaactttaggccgctgggctagtctttttctttcatagattttgatttctgtggatttattcctaaatgatttgtactctgtattagtaaagcatatacaatttcaaaaggaaataaagtttcactttctctccttgtacttaaaataatctccagtttcagaaaatagaacaaccgtttggtttgtattcatggaaacaagaagtcttttaaactttaaagggcatatttaaccttttgagcatttattgagtgcttgctatgtatggaacacttgtgttagatgttgaagataaaaattgttctacattgccgtctgtgccctgaaggagtttaatggattttccctattcaccacctgtctattacaacaccaaggttggaattgaccatgcctttctttgtgccttgtaccttgcatgaacattaaattatttgttttcatgtctgccctcaattaataatctgtatctgtcaatgaatacttattaaagaatcatttcctatccaaagatatgagcaaatgcaaaaggcccagggagggaaggagcttggtatatggagaaacatatagtaggccagtgtgactaagacttggggaattaattcattgagatgaggtcaaagttaacggggccaggtcacatggaacaaagtttctgaacttcagcattattgacagttggaaatttttttgttggtggtagctttcctgtgcattgtaggctgtttatcagcatttctagtctctggccagtagaggcatttacaccctccagctgtgacaaccaaaaatgtcttcaggcattgccaaacgtcccttgggagtggagatgagagcaaaatagttctgggaggaggctctgatgtagaaacttaaagataattttgcagcgtttagtttttcattctaagtgaaacaggaatcactttaaacagggaagtggcatataatgatttcgatttttaaaaaagattcattcgtgaggagagtgggttgtcagggacaagagaaaaacagggacgtttgtggtgagagcagcattgagggctgagggttggttgctggatggtgtgaaggaagaaggggaatttgcatggagcactgaaaggagagaatggctttaagcaaatgtcaaggagtagaagcagaatcccaattcaaagagtggcacataggaaagtgcaggagcacagaatatgcaaggcacatttagggatttgtagagtttctggaatccctgagggcctcctcagagttttagatgcaggagcatggaaagggaggctttgtattgctcggccttctcagctgcctgtggcctcccctattcagcgatatccagcttgggcttgatggggtcagaactgcatttgaaacactcagtctggcagcagtgaggatggatgggggaggaacaagagtggaggtgggtggggggagctgagtggaaagggaaggtgggtgggaagaggctgctgcataatccaggagagaaaggatgagaatctgaaaaaggtaatggcagtggggaggaggagtacagaacagataaaaagtttcatatgttatttttgaaaaatactgttttccatatttcttgcagtattctttatataaaaaggaccagtatttgaatattatttttattccattcaaatctagtcattcagatacttttaactcaaagggacatcttagaagtggcttgtttttatgcatatataggtggttttgcagaaacaacttctctgacataaccatttgcattcttgggtctcatggcaatagtttggggcaacatgaatttgaagcatagcttttaccattctgttcaacaaatgtgtctccagagtttaatgtttgtcggacactgtactagacatggtaagccttacatgttgaaatttggcaaaataaatttatcacttttttatctttgaccttgttctccataaactctccccagtgttgttcctttagtttaaactgcatcttctcaaacctggattataacagtgttgtcgtgtctgtcctctgcctctaatcttgaccactcccaatataccgtttatagtcccaacagagccatccttctaaatagaaatctgattatatcacttgcctgcctaaaacccttcagtgacttcctattgctcttgtgataaaaaattccaaagcctttagcaaaacataaaagttcttaacttctctagcctaattttctacctcccccatcttctcctgtgcaccaaatctatttcattttctcagaatggcaacttgctttacatagtttttcacgtacttcttatctctgagctggttatggctcatattttagaactcaacctaaatactacccccatgcaaaccatccctgactttgcgctaagttgggtacccctcctggatgctttcttagcaccctgaattcacccctactgtaggcctttaacactgtggttttataaacacctgttgttttgaccagctctaccattccagtaaaccactggagggaaggactgtgtattatttataactttacctccagggtctagcagagtgccattgaatgagcgaattagcatttattcatttatccatcaaacatttatctatagtatccattctgtggtacgcactgtgccaagtgctagtttggtggtgaacaaaaacatacatggttcctgtcctcatggaactgtgagagagagaggcacaattcacataattatgcacaatgtgacaccgcaaatgtggctgatgttgtgaaggagaaggagatggtatgttgagagggagttccctaatgtgatggcacttatattgagacctaaaatgttagcaagaattagctaaatgaggctgggtgggaagactattttggacacccagagaaatcagtgtgtatgcataggccttacaaaaggaggtacctggtgagaaccagtgattgaaataatcctgtgtggctgcaatgagagagttgaggctggagaagaggtagaggcagaccaggtagggccttcaggtcacattggtgattttcccttccccttaagaacaaaaagaagtccagtgtggctgaggagatggaagactttttgaaagcagtgatgtcaagggaaacagagtacttatctatctgtaattattttatcccagaacctttgtttattctgatggttatatatagttacctttatagtccatcatctaaaatcttcatttcaccctctttcatatgggcctttttgctagtcttggacatatgtaactcaaacttgttttagtggaaatagatccagaaagcatcgagatgatgcagggtaacatgggtgacttttttttacataagctattcttttgacccattcatctggctagtgtccacatccttagattactacaggttttttggtaacaagatttgtggattcttctcattattaccctgctggtacttctaatatggacttcagtgatttagtctaaagagggcataaaaattctgtgatgtctctactgtttttctccttttttacctccccacaaatgtttctcatgtctgtgaatttacaataaagtgttacatttttttcatggctaaacaagagtttataattgccagtaaggggagtatatgcatgctatttttccttttctaaaaataaacatttattgagaatcagctgtgcatcatgcactctgctaaggtattcagaatacagagaaaaaaagatacagtccggtcctcatattacttacagtctaatgtcaaagacagatgaatacatacataatttcagaattagtgtgacgagtgttgtgatagaggaagtcataaaatgcaaagcagggaaacataaaggaggagaactaacctaacttgacttacttatctcacctaggttgaggaaggaaaaccaaccagaaaaggtgagggttaatttaagccttaaggatacataggactgagcgagagaaagaacaaaggaagagtagaggttattccgggtagaagaggctatgttggcaaagacacagaaagcatcagtgaaagaaacacatatgaggcattgcaggtggttgaaagtggtggtggcacaggatccaagcatgagagagattaaagatgaggctgcagatgtgaacagaggccagatcatgaatgaaccatagtggggtcttagacacacaaatagggaggagggagaaaattctgtaggctccaccttaaggtatagccagaacccaaccgcttcttaccatcttcactgccaccactctggttctaatcatcacagtttcttccaatggttatttagtcttactatcttttccctattcgcctaacacagcagccagtgtgtttagaacataagcaaaccatgactctcctccatttcaaaccctccagtggtttcccattatactcattctacaagcctaggttctgatagttctccgtagtacttattactaggtgagaagctgcatattttatttatttatggtattcattgttgtctccctcagtagaatggagactccatgagggcaagattttttttgtctgttttattcacagatgtgtcaccagcatggtactaagttggcagtcaatactcattgaaagaatgaatgactgaaatctcagatatatcatggtattcacctcactagtcattattgaacaaatttatttcagctcatcccacctctgccctcctttcctctgccttacaccactctcaattcaaactattatgccttcctgaaaagaactggttttatgaatgtatattaacctatatctattcataatcccaagtagatttttgttcttagccaagcctggactaggtgaatacatgcttttctttcttgtactagctcccttgcctgtgatgagttctcagaacatgattagatccatgtgcgtgagccaggggtgaaatcttggcatttcagtgagaggagagcagtgttgtgacgaactgtaacaagatctgaatgataacagtcaccaggttcctagtgtaaatcacatcctcattttttaaaaccaacctctttattccttggattggtcatactctggctcttggcactgctgcttccctgctgtgaaaatggactgctctattttctcaggctccataggggtatcaagtatttgatttcttcataaatagagcaaagaaatagaaccatagaataacattgcggacacatttaacaatatttatttaatgagtaaaaaagctagatcttttgttacattgtctgctcttccagtcagtaaatgttattgtgaccattgggcaatgtttgaaatcggcctattctgattaagggagtgtttattacgttaatggtgatatataatagattgttaaacatttactttcacatattatgaaagctgagaaatggcctacataccttctcaatcttgctttcggatccttacataagttgagtactgtctagatgaacagcatactactcagcgctgtccagtagagaaggcagggtgcctgctttcaaggtgcttattatgtttatcttaacaaaaacaaccagtaccactactgccgctatcaccatttattaagcacctatgacattaacaactacagtttaaattgctacaagatgctttgcctgtgttacttcattgaatggtcttaagtcctctatggagtgggcatatatatctccattgttctgattagaaaattgtatacagataggttaggaataaacaaataataagtgtatctttgacttaagtcttaaacagttattcaacactatagtacagaaggtctctaccatagcagctataagatgcagctgtgtgtttaattgctagggggaataatacaaagaagataaagtcccctctttcaaggagtttaacttaccaagcaaagcaagtcagtttcctttggtcatcttaattcccctctggaaatatgactagatagcgaatatgagtcttttcttcacatggttttgttatctctttctacagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgaggtgtgttaactcagaggaaaatggctcccgaaaacacactgtgcacacatctatgtggcaatcataaggatatgggcagatttggaggagacagggcttgtgatgattaatttattcctatattttttgttccagaaaggactaaattttcatcagaggtttcagtgatttttttagtttactcctcatgatatatcattttcatggatttccaaaaggctaaatgttgcaatataaaactacaaccagattactttttttcaacatgcaggtgattttggtgctgcagtgtttactgtatcacagtcatatgtgaaggccctaaaactcttgagtctgcttatgacttttaagattctgtaatgggaaaggtattcttattttccaattcattttctgtccccataaacactgagaaactttaacctccagacgttcaatttgggtagctgtgaagggcaggagtagaaggtttttatactctgttgagcactttttacagcaaactctgctcataagtgcttgggtagagagctcacatgacagagccatcgtttcccacggcaaaacagtgggtgattcttttttggggtggggagggggtgtaggatgggaattatatttgttgaaaagtacttttgttgttgtagatttggaaattagactgatgtgatttattgtgctaatgaaatttccttgagctgtttgttaattggaatatgggacaatgtaatatctgtctcctatgaaagaaggtgtaagggtaattacacaagaggataaattgctttaaaaaataaggtcttcaaagagtccagtaattgatggaccaagagcaagtgatttttctttcttgattccaaaaggagcaaaaaatttagcaggattacttctttcttcgtgaattcaaatcacatattgcagtcactttaagagatttttttatagttacgttgggtttatacgctatccttgaggtattatttacatgatatcaacacctttgttgttttagccaaacattgattttgtcaatgtgtagtttttttgaaggtgaaaagacaagagcatgtttatgaagacaagaggtagattggtaatcttttgatttggtttcagggaacaaagagtcactggaacccttgtgtttattctgactggtctgtcagtctttatggctcccatcttgaaggtaaatatgtgaaacattcacctcttccttctcagaacactgacatataattggacatgtgaagagtgaaattcctcatgagatatttgcgagattctcatcagttctgtaacacactgaagcaggggtcaagtagaaagagagctttaaatagcttttgtcttgatttccttctcactctttcatcccctcccttatccttagttttgcagttatttgattgaactatattaaattaacaatatccaaactttctgatctgtgaaaatagtagtttcatgcaattgaatcagactgatcttctccccctcctccacacacacattttttattctccttgtcttttatacattctttcttctatcaccttccatttgcttgtatccaaatcttgtccctcttccctcattaggctcctaaataacatgagtgatgcaggataaccattttgatatttttcgactattcttaattattactttgtttctattttatttgaatcagatggccttataattcacaaaggtaaattagagtaaaattactgactcataattagaaagctttagaaatgaacttttgaagaagaaaaattatatgatattggttgtttagaaaattaggggtcaatatataggtttattgatgggttggatatctgcctagatagataaatgcaaactgtatgtgacaacctattaagaagtaaactaaaactaaaaactaaagaaagttagtgtatacctcttcatgaagtttccaattttcttttatgatgcaaacattttatttttttcaatcatataaacatgcttgcgaattattgatagtttgtatcttatgctttatactacagtacaaagcatgcaattcacccatggacctaacagctataaacaaccactgttaacgatatccttccaaattttctcttacaatttttatttttaaacattttaattttaaaggcttttaaaatgctcatataattacataagtaatggggcagtacaatcttctgaagaattcaaacaatatagaagtacacatagtgaaaagcaaaagccctctgttcatctaaagttagcaaattttatgtcagttgccaatcagatgaaattgaggaaagtggaactgtaatatctttgatctgtaaataagactaagattgccttcagggtatttagactgatgtatacagtatgcacaaaatacttgttaaacagttaaaatatgtaattattcatcttttttccttggtttccacaatgtcaatgaactggtttaattaatttctgactggattcatgaggaaatatgtatctcatcttagacaagacattaagattaaaaataacctcagaaaagttgtttctgactatgtacagagggctgtaaaagagtacagagcttatgttctgcagggacagagggaaaccttttgtcacctttgccagtgcaaagcaagttatgggataagtgtgaagatgtggtgactttcacagcattgaatctgctgccaaatgctttatgttcttccgttatcctataggcaccagcacatcagctggtggaaagcctaatgacagtgttaccttttaggcaatggaacctcatccagtgagatcatttttagagagttcactgcagacaattatgagcccatgttgtgagaagctctcctggaaatgaattttccctgtgggttccttgaaggtgggctcacttcaagtaggtgcagagtttcttttatgagctctctttgtgctcagtcactagtgagggataaatgggcagaatcttttcatcagttctaatttactcatcgcctcccccatttttcttttatttttatattatttcttttcattaatacagtataaaatcctaattcaaaaaagtcagatgtgtttaaaagttccttttgtgtgtatatgttacagcaaattggctttattcctagagaatctgacagttgagtaatcatggatgattccaaggggacacagagaatagatactgtataattactatttttaggagagatgcaagacttacattttcaacaacgcctcttcctaactattttctcaccctgcacccaaatatggctgcagaggagttaaagctgaaagttcttttgttctttacaatgattcttttcacccctgataggcaaagtgccttagtatttacagaaacagattagaatgagagaaagaaggcagagagctgtaagagatcagtgagcatgagctttctttccctttgaccttccttaattgatccatacctgggctcatcctcattcagctgctagtgttcatgattgtggctatttccacctggcaattttgagttaccccaagtagtcattgtaagaataaatgaaaaatgcagtccagcaaacgtttttgttaaggttttccccaaaatgtgggaaatggaattgttttggcaatatagtttatagcatactgtacacaacctatatttaaaaacaacaagaataaaacagtcaaggattcgcagttgtgattctttacttcagtaagttaggctattccttacttcgggaatcacaactcctgataaagtcagctactttcagattatgtaccattgaggtttggtaagttaagtgcgtttatcacaaatcccttgttagctcatttgaaaagtcaatacaggaagaagcagatattgagggtacagtttaactaaaacctaagttatgactaagtaagagtcaagattaacaattaaccttagaattcacaaagaaagtggtgtcaggggttatgttggagtaggaaaccttttttcctcccctttgtgactatgtgtttttttagagaaccagaggacaacttaagagaatcattttacttaagagtctgtctttgaaagggcagatcaaatgaatgggaaaagagaaatgtgttacttttactttttaaaatgaaatggctcaacaccatttctgcaaactccatatatccctcacaagtttaatggtctcagatgatcctagtaattttctttcatgcattaagcagtgtaggaagttgtttctcctgcctgtttatgcaagcttactttgaaaatgaagtttttcatttttattctgatctctttgctgaggtccgtcttttatgtggaagaatgtaaggaattacagttttaagttcacgaggataccccttgaccctagccagcaacagtcatacatgcctcaaagcactgaatctaaccactgattcggtactgaactgttgggaagcaagaataactggcgcccctggctggttaaacagcttagttctgtgtttctgcagcagaaatactgcctggtaagtgagtattctgtatggggaaactagaggaggctaaagagcatcaaaaagatgaaaggcacttccttgagcttacttttaccatttttctggcaagtctgaagaaataaaaatcaagtgaagttcactgctacttttgttgcctttgcttgaaatagtttaattcaagttaattaggagtagtcaaatttatctttaagatttgtttagtgttctaaaatcaggatagcatttaatttgtatttggaaaatatttgttgagcttctacaatatgccacaatatgtcactttgttcagtgccagggaaagcaaaatggtagagatgatggtaatggtgatgatgatgatgatagtagtagctaccatttattgagctcggcatttgattaagggctcaacacagatttttaaaatttagtccttcaatgaatgacacctacaaaaaattgtctctcttttacacataagaaaatttattaatgacttaccaggttacaaagttcgtaaataatagagtcaaaatgtgaattcaggcagttctgacatgaaagccaatctcataaccctcagggtttacaaccatttaaaacaaaacatagtacttgctctcaaagaactcattcactttcattttccatgagatgatcttctccagcttctttgatccaacttccagtcctttcatgtgcagataaatacagcattttcacaaactcctcatcatacctcattccagtttcttcaatgactaggaaccagattgcaagtcagtacttccttatcagcttagattttcaagatttaagggaattaggatattatttgaataacatgtttctgaatatagttgttactgctgaaagggcaatatagtagaacttaaataagaccagggctttgaatctgacctttgcagccattcttctggtctgtactcctgccattttccaccctgaccactgaggaccaaggagagttctgctgggcaattgcagcaggcttcttgacttgccagtcaggtcttcatgataattatgacattaatacctcatttatcatttattatctattcagaatgaggccctggactagatattttatgtgatatactctttatcataccctcttttaaatgagaatactgaggataagaaaagttagtaatttctcaatgttacataagtagtagggccagaatttgaaactaggcctgtctgacttttgtgcccatgctcttaatcaggatctcgttctggattgtacattcacatgtacacacacacacacatacacacacacatacacacacacacatacagtgacgattattctgctagaaggtctcactgctgtactgaattctggttggacaactacactctacccttatttttaaatttacccttttctcgtttactcttctgggaatattcaaatactatcagcacatcaaagggaggtataagtgaaaaagagtagaactgcattcaccagaatttgaaaaatttggtgacatggtctgagtatgttaactcctattttgattttatctcaattattccatctgcttgtagggtcaatacttgatttcatgtatggtaatcttatttataattatacttttgtgctttctgggtatgattggttatccataaaatttcctttacataattttatcatttggcaattcttgatatgcctgtatggtatactttgtgctgtttatgttttaattactcctgtcttgctttgtaaaaatatctacctactattactatgtaaattatactggtttaacttaagatggagttccatcttcttaaaatgcatcttctctttcctcctttgagaaatttctattgcaagaaatgattattttgtgatgaatttttaaggattgacctcctgtgacccatgaactaaatccaataaaaagtatcctctaacccaataattctgtcaagtttcatcaagttttccatattggaagatttttattgagatgttgcattatcataaggaaaatggcaaatttcaaaagacatatttttatcacattgaagttggcccaaagtcaacttaatagccttctttatatgtattatttccttttcaacaaagaataactgtttaaaaaacatcttcatatctaaagctatttttctacccacaacccatgccattctatgttactgataccttctgattttattttgtggtagatttggtgatatctgtaataataaattcacagagaatggaactaagcaccaaggcaaaagtgtccttcactttgacattagaaccacattagaaaaaacatttagctaagcctagctgagggatgaggatgaggccagggatggtccctttgtggtggctttctttcaagcaagaaaaatgctttacccagattaaaaaggaactactgcaggaattctaactagttttccatggttgaactatacttctcttttcccttcttacttttctttccttccagctgccccacccccaccacccaccaaattgaaaatgaaatgacaagaaagaaatatgggagatgtttaaaaaatgaatcaaagctatgcaatgatccttctcttagtttttttactttatggtacatttatacacaagaatcacaaggaatagaaacatgcacattgcaaaataaatgaaggcatgtgtcagaaataaagaggcttgagtgtgatgtgttcacctctttgtggtgactgttaggtattacagcttccccagcaggaacatcatccctcctacccccgtcaacattctatgtcacttttagttttttctgacatcaagagcaaaattagctacattaaaattgttagtctttttttgaagaagcatttgatgttttgtatatataaataaggatatttatttcatataaatttaagcatccctatggctagccaataaaaattggaaatatttgttacacattttagaatttactcattctctaatagtggccaaagagtctcagatatggaactactttaggcaatcacaaggagaggctgatagaaattgtgcttcacttagtacgtgcagtatttttaaaattactctaaagccatactatgttttctggttacaatagcctcctttatgtggatttggtaagattggccttaattgacttgcggttttagtattttagctttgaaaaatcctgaaattacttgaacttcttttcaaattctaaggttgagaaccttttgtttttcaaacagaagacttcccagaaacagaatcatccttgatttgcttagtttcctcagtactagggacatttcaaaggtctaggaatagatacagtttacagacatcacttctccttgttaaaacactttgtattaatataaaatattttttgctaatgcatgaaaaggtattaattcagttttaaaagatgtgtattaatccatgtgtgtaattaattgcttccaagtgctccaaggtcctttcaagcagttctctttagttagttctcataatatttgcaagaagcgaggggatagtcttttgatgtttattttattgaaagaggcatctatataccaagctgatagactatttggcaaaaattattaaggacaaaaatgaacagactatattgaaaggaacttgatctcaagagtgaggcaaccatctattaatacctctgtttctgtctacctcacagtccatagaagcatcttgtttacatagttattccttttcagggtgaagggaaacataacttttcctccattaattaaaaaaaagttattagtaaggtcatgcatgctcactaaaaaaacaagcatccaatgaaaattgaaagtccattatacccttcttcatttatttctattacaaagagtttagaagttcatcaattgactagtaaagcatactagttagaggtcactaagttattatatcctatattttagttttagatttagcctttatttaaatgattcctcttcattcctcttttttcttgttatcatttttaagttgtatccatttttttccttctagtttatacccatgcctgtactctatggtgtgttcctgtatatgggagtagcatcccttaatggtgtgcaggtaagtttttgaatagcaatgtaagtacagtagtgtttttctagtagtaagaatagtccagtaacagatctttgaagaaaagtgctaatcattattaactgctgagtttttaaaatgcatttattttctacttcaccattcacctgcttttcatttctggtttaatcaacaagttagccagtattaagaaaagttgccatacatacccattgtttaaataggctgttaaaagtcatttaaccaagaaagcaagaggctataatctttcttttccttccccttacccatctttatctcctttttactgtctcaggaaggatacctaactctttctgtgtgttcttaaagatagtgtttatccatttgccttaactctatactaaaaacaggctattgatttgcttttcacatggctatgatcaataatcaaaagtttttttaccaataaaagaataaagtcaatgtggttgatgtattgcttttgttgaaaacttcagctattcataactttgggaaaactgacacacttttaataaaatcattatcaactgggcatggtggtgcacacttttaatctcagctacttgggaggctgaggtgaaaggttcacttgaacctgagttttagtccagcctcaacaacatagtgagaccctgtctctttaaaaaaaccaaatcattagggagaactttgtaagggactttgtctttcaattgggttttaattaaattggcaccaggaaactggaagtacttatgctgttttctggcaccttgttaactgtagccttatttagcacttagtaatattttaatgggaaaagactgcatgtcctgtgaacatcataagaatttatttgaaccccttcaaaatagtccttgcttttgcttattgaattcagattaatttggttttaaagtcagatagaactgggcaagtggccagactaccaaaaagagaaaaggctactttacttttctctgtttaggtctgctgagtagagttcgtcatcttttggatatttgttacaaaatacaaggtggttcttcatagagtggactagatgaatgtgagtttatttgtgctcatgaaacttttgggaagcataaatctgtaaaaatattttatttttacctgccattgtaaatattctttatttcccaaaatggaaaaatgtgaaacagaaatggcccacagacaaatagttcttatttttatttgctcttaattacctggtctagatcagaagtttaattctatgtgttttaggggctttattggttgaaactcagtgcatgtttatttaattaaaaagaagaaaaaatcaaccacataataatgatggggaaaaacaaccagggtccagctagtagatttcttaaattctgcaatgctattgcccctaatggcttttctctttctttctttctcgattctcccttgtttagacctttttggtaagatttcatttagaaaattttgtaatttgtaaagaaattttgtaacccaaactttataaatgagaaggtcctcaccagtcaaaaatagttctagagggaaaaagaaaaccctttaagtaggaaatcactagagaagattgtgatggtctaatttacttttgcacttctttccctccagaaagaaaatagagatattatttcagagttcatattgcatgattattcaattcaatagctatttactgagcatctttcattgaaagatcctgtgataggttcttgaatatcttcccattcgtcactggcaaggtcaattcggcagttattctttgaagcacagcacctgacacacagatgctcagtagttatttcaatagctgtttatacatcaccatacgatagcatcccttagattcagatgttgaccctgaaactcactgtagtattcatatggcttttctctgaaaagaaatggtgatagattgctgagtgtattagtcaaagtatgccactcagataagtaatatggaatttatgaaaacataatgtattcccatttttaagttggatacttcctttatatccttaaaacattctggaaatgtattaatatatgatgcatagtgtcatctcctctttgttcagataagacaactgaggcagagtaagatacatgagctagacatcttccttcagcatattagtactaaaataggcaaaagatccactttcctgagactcagagagtaaaaatagaaattaggagatgagctcctagaattttttttctttgtgaccttattctttagtggccactttttcttatacatctacataacattcccgcaatataataataaagatttgaagacttgtgctttagtgtgcttgactaaatttctgcattccttgaccattcctttgtcctctgaaaaggacactgcttgcctaaattatagaatataaatcagtagtgattagttaggcatagtggaaatgtaatgcagtaatgcagttggactcctttcctctttcctccccagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatggtagggattcctttaattgaacgtacctgtgagattatatgagtatcatgtggttattgttatatggaagacacacatgtcttttatgtgttgttccaaatttttccagctttgacctcatcactttgatcagttgtaatttacatttcccatgtttatggttgtctaggatggaccttagaatcaggctcacctaagttcagatactggccctcgttcatgctcagcagtaaacttctttgaactactattacctcatcagtaaaatgggagttgcattgttgtttttctgagcatcaaaaattaatatcaagcatgtagcacaatgcctgacacatagtagacaccagtgcatgttaattactttttaaatgttgtataatagaattaatctaagtaagagtgtaggacatttcagttcaagtaataaagaagtgcttggcaacttgtgagaactcatccagtacattagaggaaatggagtgagaagttcactttttacatttcttgtggtttgcataatggtaagtttaaagataaggtgggactctctatccttgtcatagtatgatgagaaacaaggtaaagcaactaacgtttcactctgagtcacaagtgaaagaagagaaaaaggagttctgtatttggcatcactactgaattttatactttaccataactctttacttcttgcaagaaaatgcatatatgtacacttaaaacaagtcacaaagggagcctcaaatctgttttatctcccccacagctttgaaaacagaattttcctacacttaccacattttatttttataagaatcctcttactcttagccagtattattattttatttttcatatttgttgtttgaaatttttttcgtccaaggatgcaagaaaaaatggatattaaatactagtgatatttgttaggtcagatttttttcttaatggtggcttatgtctttctttcctttttttaaaaaaaaactatattaacttactgaaaagcacactgagtatgagaaacactcaaatatacctattagtgttatctgcctacctacaaattttgctgaaaccaagaaaattgaagctagaccaggatacatttgaattatatccaataaatcactttttgcttgtgctaaataataattttaaaatggtttacttttccaaagtgtttttgtcttttcagaacttttatttggtcacaaaataattctgtaatagaagttaggacagatgttatttatttctctaggtgatgaggaaactgtcatatagagagcacgatgctgataaagacaactgcttaatttgaagcaagtcaggatgcctataacttgctgcatattaattttaatatagaataaagatatctttaatgtaccttcagaagttattcttcaagagcaattcatagaaccaaaaatacacaggtcaagaatatttgttttggaagcagacaactgggaccctttgtattattcagttatctgggttcatctccctcacagacattaaggaccttggacaacatacttaatgtctctaaccttcaatttcctcagctgtatgataaaaataataatacctattttgggggtttgttctgaagaataaatgagataatattgcctgagagtttaacataatgtctgggacatgttaaatattcagttaacggtggtgattgaagtagcccagtgaatgaaatggtctatgcatattcaaatactacctcattgtgaatactttgaagatgtcttagtgttatatgtgtcgtacagattttcttgattgctaaaaacctttatgatgttttaatttttaatacttagaaatcatatgccagctatttttttactttaaacttttaattattttatttaaaatctcacatggaaggcaatggttttgaaaaacaatcttttcacattaaaattctaattgaatgtgatcatgcattttggtgaacaaaacaaagtgagtttcaactaagacttttataaaacaactttccccatgtagaaaattatgagagttcactcggtataagtccataccgtcaagatcaggtctgtcatactctatctagccttacacaaagtaggtttctgtggtctttgataggagagtatctatgcttgctgtgacttcatctgacatggtttctttcatacttttaatatttgctctttcagatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgatgtaaggaactttccaaattccaaaggaaagctagttaaagaaacaaatgtgaaaattgtccctttttatacctgatgtgaaatggagggctgagttctaagaatgtttatctggacatgtggtgtattactcatttcacctccctttgccctttatattctctggttttttatgttttctgaattctttctgtaaccattaatacactaataatgacataatgactaataatgacttctaaaaaatttaaaaacccaccacattaaaaaaattctgatctcatagatataaaggaagtttgcttagtaatgctataaaatgtatttggtttctattaataacccagggcttatatttgagataataactcaattttatgtaattttaagcctaatgtggatagatgtcaatgatctcacttcacgtgatctgtgaatctatttgagtaggctctccaccaaagttctatgctgttatattaatattagcattatatttatactgatatgattcagcattatttttctgtagttcttcaataaaaagaaaagggaatgggagtttggggtctttttacataattatagtggttagtgtcatagtccagagggtcctcctccaattaggtgattaagttgagaagtaaaattgttgcccagttttttctttaggagaccagctcacagaaatacagattctccagcagggatctgtaatcagtactaggaggaaaactgggatttgtttactttaacacatgcggacaccttattccagtagccttttgaaaagattgccaaaataatgttttccatttgaaaatttgctctggattttacacagtgcagtatcacaaatgattttttgtgcctcattacccattctaaagtaggaatattgttaattgttagtttctacttagtacttgataactttgattgatcattgcatactttatccttaattgtctcaatagcttgttatcacattatttatttttgttcccattttacagatgaggagatttagactgagaaatgttaaatatgttttagaaattttaaagctttattgaggtacgattgacaaataaaattgtatatatgtaaggtgatgctttgacatatataagtcatttttctaattgtacacagccatagtggcaaggccaaaactcaaatccaggcctctctggttatttctaactggtcaggctatctgattgtattctttttgtagaacttggaaatagtacagtgaaagaaggcaagagacagaattggatttcacataaattgattcaataagaaaaaggcttaatgcatgaggcacatttagctaaagagaaaaagaggtgaaaagagctttatgtctgtcatcatccatctgcaatgagaacaggtatatagattttgtttccaatgatgacagaaaaagaatgtgtttaaactacagaagagactaagacgtaatagtccgaagaacgatgtgtttacacatttaatagaaattaaaatttgaaatgaatttctggaccactcaagaccaaaaaaataaaaggctgcctgaaatattaaaataattaaagcagtattttgtccaaaataaatatgtcaacttatgtacctggacatcaaatttaaagttcattacacattatgagtgtgtgaagtcggggattatggaatccccctctgtaatgatttttgagaaaaaatagtaaaatatcagctttggagaatgttttaaatgtactgctctctagtgacaaaagttggatcaaaagaactccttagaagttcttccaattcttagatatgatttccaacaaatcctatttcatttaaagtgtttttttgtattaatatttaccatgttcaactctgtgtttccaacagatttcttgaagccaaagtgtcgtacttgttttttacctcttcctcttcatcctaccctttccaaaacaaacaaacaaataaacatatacattggttcctaggcagtgaatccagctaggcaatttagagtacgtctgtgcagtatgttctgtgtgttgaactcattatttaggggctccacattacaaatgtggttctcctaagtttactttttagtcatagggtttggggcccatggatatagggagtcatgcggggacatgagggttacagctataatataatatttatgagcacaattagtgaaaattatagctcttcttgttacattgatccctttaccattatgtaatgcccttctttgtcttttttgatctttgttggtttaaaatttgttttatcagagagtaggattgcaaccactgcttttttttttctttccatttgcttggtaaatatttctccatccctttattttgagcctatgtgtgtctttgcatgtgagatgggtctcctgaatacagcacaccgatgggtcttgattctatccaatttgccagtctgtgtcttttaattggggcatttagcccctttacatttaagattaatattgtttatgtgtggcatctttatttttttttcttttttgctcgttgaatgcattatcttagttctctaaaaggatactgttgttcattaacctctttagagtcataaataaaggaattttccatgtaggtaataggctttatgttaagattttattaacattaattctcattttattttcaactaaaaaccatctttttggtacttttaattaagagatatattgggtctttcagcccaaacatagacttggaatcaatataatgcatttaaaaaaaacaaagtggtaatctttgggaaatctattataatttgggctaggtggcttgttctttaagcagtcccatgattagctgcctggttttgtcatttccattatgattctctgcttatctgaccatcatagacacctttttaaacattttattttcttatgttttgcttacattttcagatatctttggcacaagctaattgaaatgaacctttatccataaaatagtacttaaagtaagagaggaaagtttattttctagtgtacatagaaggcttcttgatagtggatatataaaaagtctgtcacttgttctagaaggaaagatcggtcatgattttatctagagacggaatcagcataaacaaaacaagaatttcaagaccgtattataacctgggaagtttcctatgtttaatctgtttttgcattgagatcatttgcttcacacatacaactcataaacattgctgattgggagtctgatagaaagctttacaattcagttgtagatcgatctctattttgtgcagttatagttttaattgactcaataccattaacttagaagagtggaaaacaaatgtgagggggaaagaaggaatgcagttaaaagatggcaaactggaagtaattataaggcttttctccttagtagtatgtaaatgattatagaaaacggtttgatcgatgctaggagataggaagggctgtataataaaaacattctaaaacctcttgtacatttttttcacagtctgactgcccatactcagaaaaagttccaagtattaaaattccaatggacatcatggaacagcaacctttcctaagcgatagcaaaccttctgacagtgagtagaactaacctcttgcatgcttgcttgaatatgatttgcacttacagagaaaacactttagaatggccatctgcattaactttccctcaattttgtttttcctttttctatgagaagatttacacttaattataataaaactttgtttttacataccctaagcttcattcttccttttatccataaacttttaaatttttatttggtagtcttttctcttacccaaatcatccccagtttttccaatggctaaattaataaccatgtttttaattgatttttctttttttttctgttggtattgagaattgcagcttataatactacatcactgtcactgtttgtcttccttaggttttaactagtgatcaaatcagctcaaaagagaaattgcatcattggtctctcagtgatcaataaatcaattgttaatattgagaatttggaaaaatttaattttgattaaattagcaatcatgaagtattagtacaactttctagatataacttatatgcatttgctttctaatctcttcattctcccttttgctatttcaaaattattattataactgcactgatctttctagggtgatagcctggtgactacggtgcaatggtttgtgacatttttctcttctgtaattgaattaacaggccacttagtaatattagtgaccatttcagactttcccaatagcaggtagcaattgccatcaagctactttctactttgcgttctcattgaagaaaatgcatccttttagattcagatgcacttcagagtacactgatctgttacagaaaaagacagttaagacacttttatttctattttaccatgccacctcaactacaataagaggttactgctatcaagaaaagtttggaatgaatatctattgataaaaaataatgggtatattagttatcaatcattgagtaacaaattacaataaaactcagcagcttaaaagaacaaacatgttttcttacacaattcctcacattcaggaatgcaggggcagctgattttggttctggctcagagtctctcatgagattgccgtcagagctgtcaagctgtcagctggggctgagtctctgaagactattttttttttttccaggaagaaatgaaaggatgatttgaaaattatagtatactccacagtgtgggagtgggcccaagaatagggactcaagggccccattacaaaatttttgggagtttaaataccctctacttggggtacgccctatgtaaatggagaggatgaagtaaagttacaaactcatttatttggcccacgccccatggagaggatatttcctgtcatagccgaagtgtgaattggccttatgttccctgcctccagacactgttttcctgccacatctcctcactgagagatgtgatctccatacatcttcatgggaggcagagggaccgatggtcttttttctgtaactgcttcatgctggcttggggcatactcctacctattggggatccctgaactctcaccctgctctgtctagtggaggcagggtagcttcttgatggccagggtgttgtcttcacctggaactggctggaacctttgttgtgtgatcatctgaagctgatggtctctaggcaagaggaaatgaatttggttaaaaaggggaaatttttttaaacaaaagtctgggaagccattgttttgaactaagctcatgcactgggccccaacagaccaaaccaaagcaaaatgaagtcatttgtgctaagactgtaaggaaacacgtgaattctagaacagagcaggttttgtttcttcttctgcaaatctctgtaacaaacattcttgacagcataggtatccaccccctgaggttcccattaaatattttagtgtctgaagctgggtgtctgcttccaaaagcatactcatggggcccttgggatgacctttgttttttacctgtgggtatctccgtagggctccccatgatatggcctccctcagagccagtgataaaagagaaagaaaccaagacagaagctgcagtcttttataactaaatctcagaagtaacggaccattacttctgtcatattctggtggttatgcagccccacactgttaacactgggaaggaattacacaaagtcataaataccaggagacaggatcactgagagccatcttggaggctggctaccagcctggatttgaagaacaaagaactaaagcagtcttacctttggtgtccagtttgtaacctataacttgtaaccgaggctaatttctgctaacccctattaatggggtttggttatgaatttctttttgagtttaaactcctcaaaccatgttctgacttcatttttctccatggagcattaatagcaaaagcacagtctaacagacatgtgcctagcatgtatgtcttctgttggcatcataacctggtatagccccttataaagaaatgtaaaagctattttttaaaaaaattactagccagaatttgaggctcatggaaaaagtttatgtgccatttgcccttcatcctctcaaaaccccttttaaaggataaattgcaagttgatatgatattagaagtttacttaaacaaaatacacttgagcattttgcctgaaatgtttcctaatgtcatgtttatctttataatccatgatgaaagaacaaaactgatagaagtagtgttgcagtatgagtaagtgcctcaaaaaaaaaaatctttttttccttatgaacaacagcaggcaaacctaggaatactgaagatggaaggaaatccaaaagcaagccttaggcattaagagaatgctatcaccctctaaaaatgatttgcttcttatccttctcactgacaagacaacagtgatccatcccagaaaacctaaagtaaaagagatgaagtgattttgtcttcatcacactagagtcttagcttaataccttgtttattgaaatgcctaaacttgtcttttttactcttaccagttatggaagatgcatcaattttgtgaagatttttgttttatacttcaccaaagatctaccatttatgtttttaaaaaattttattttccaggagaaagatcaccaacattccttgaacgccacacatcatgctgataaaattcctttccttcagtcactcggtatgccaaggtaaaggagagcccagtattttatgtttttctgtgggataattgccccacagaaatgtagttaatggtgggttattgacagaacttcttgttctccttcgtctctattatttatcttaaataaattacccagtgaccaaaacttgttccagcttttactagtagaaagcattctaagagacctagttactattacaaataatggaatctttcagtatcattaagttacaacccaggatcaacattagctcttttaatttcagtatcgtccctgatttaaagaggtaactggcactttctgacagttcttctccagtggtttctttccctcttaatgaagttctagggatttcagattctacttgattttctgaaatctctgaatgtttttattatgtcagtctttttgtcctttaatttctgacagcattacccacctggtagtacctcttttccttttgtgtttgttgtttttattaatttaatctaggtatgagatcttatgaatttttttacttgaatttcttgactctgctggtaaccttcatcccatttaaaatgtttgtttttaatacacaaagagaatataaatattaaaagagaacaaagaaggacacatttgacttctatacaatgcataaacatttgacagatgatgaaggaaatctgatttacttactacttttttttttcctttttctctagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgc

SEQ ID NO: 36501 - DNA, 61666 bp, Homo sapiens
cgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttagggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttctttctttcttttctttctttctttctttctttcttttctttctttctttctctctctttctttctctctctttctttctttctttttttgtggagggtcaaagtattttcaatagcatgaaaattgaagttttctttttcctttttttatttttgatagagtgttgctctgtcgcctaggctggagtgcagtggtggggtcatagctcactgcagcctcaacctcctgggcttaagtgatcctcccacctcatccttctgagttactgtgactacaggtgtgcatcaccacacctggctaattttttatttttatttttgtggtgacgcgagtgtgggggggtcttcccatgttgcccaggctggtctcaagctcttagctcttgggctcaagctatcctttcaccttggcctcccaaagtgctgggattataagtgtgagccacctcgcctggtcagaaatggaagttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcaattgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgactatggctcataccttatttctcatcatatctttcacaaaactaatctgtagaaattgtatcagttttggtcacacttaatgccctagtgatgttcttcctatatttttgactatcagaggcttcaggtgtgattggctggaataatgggctgaaatccatgaggaaaccagtcactgccaactgggagaatcacacattagtagggccttgggtgatgctgattttttttatcactgggagacttttcagcacaggagggtcaggaatgtgtaggagggttaggacctctctgttttgtgaaagatatctctttgtggttgtgttttttttgtttttgtttttgttttgagacgcgttaggacctctctgttttgtgaaagatatctctttgtggttgtgttttttttgtttttgtttttgttttgagacggagtctcgctctgtctcccaggctggagtgcagtggcgctatctcggctcactgcaagctccgcctcctgggttcatgccattcttctgcctcagcctcccgagtagctgggattacaggtgaccgccaccacgcctggctaaattttttgtaattttagtagagatggggtttcactgtgttagccaggatggtctcgatctcctgaccttgtgatccacccacctcggcctcccaaagtgctgggattacaggcatgagccacagcacccagccatggttgtgttctttgttgcctgttagtggtcatttaaagtttcataatataaatattttctgtgcctccctctatgtaggaggctagaagtttctgctttagtctcttaacaaagctctgtttttgtatcctttcactgagaattgctttgactctatgactaggatttggccttttacagaaccctcgttaacttgatctgtgaatttttttcaaataccaatttttcagatgcctggtgccataataaagggatcttgattttgttttcaacctaaataattattctccatgctgttgttttatcgaccaaggtatgtgtttcaaatttgcccaagtgctgagctctcctcagggtacccagtgatgcttcagcatagggttgggcaaacagtagaaccagtgggcactcgggaggcggaggttgcagtgagccgagatcacgccactgcactccaacctcagcaacagagtaggactccgtctcaaaaataaataaataaataaaataaaaaaaaagaaccatggttgggcttggggacatggaaggaatttatgctgccattattagcatttgtagtagcttgtctgtgatttttgcatgtaaatataagaggacagcttttactgagcctcttaattagctcttgtggaatagtagagaaaagagctgtttctgtctcatacaggcagaacgactggatctacaggcttttctcttctaggttatgtctgtcaagtgcagttgctatctaacagtcagtttttaattttgtttttggaggtgagatatttttaaaaggtgtctttcatttattttaaattcgaacctttgtttaaacgtttttaaagttggtgtcattatactactgttcacgaatgaatcattactactctaaaaaatatatgtgactataaattgaccagaaggatccctcctctctgctccctccctgcttcctgggcaactactgcctttttttttttttggacagagtttttgctccattgtcctggctggagtgcggtggcatgatctcaactcactgcaacctccacctcctgggttcaagcaactttcctgcctcagcctcccaagtagctgggattacaggtgcctgccaccacgcccggctaatttttgtatttttagtagagatgaggtttcactatgttggccaggctggtctcgaactcttgacctcaagtgatccacccgcctcggcctcccaaagtgctaggattacacgtgagccactgcgcccggctggcaacgactgctcttatacctcctcatttctgcttcatcacttctcacttgggtctggtttccactcctgctactccactgaaactgctcttatcaaggtcacctatggcctccttgttgccaaacccaatggatacttctaatgcctgccttactcgactttactatagcatttgatagtttttatcacttccttctcctcaaaaatgaattttttccctttcttcctgactttgccaccactggttcctttttttttctactcctgtgggttttccttctcagactccttcatcagctccttctcctctagcagccccttaatgttggctgttaatagatcaaaccccagatctatatcatagtcttcttcccattttacttgctcccctggcgatctcatctacatctgacttcaaccatcttatgactgcacagtgtatatctccagttgagacccctcgctttagctccagataccacatactcaactatgcgtgtgtcacaagtacatccaactcaacgtgtccaaaactgaatgtagccttttcccctgtaaatctgttcatctgtgtatgttccttacctcattgaatgtccttgttatccccctcggtgctcaggccaacttacccacctggttaccaaatcaattaaggttcctcttagtctttcatctcccttcctcagtcactaaatcttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctgggattacaggcatccaccaccacacccggctgatttttgtattttttagtagagacggggttctaccatgttggccaggctggtctccaactcctgacctcaagtgaatcccccgcctcggcctcccaaagtgctgggattacaggcatgagccactgcgcccagccggtccttatagttttatagtacttcagcacattggctttatttgataatacctaaaatattctattaatatttctttcaattctttcttgccttgcttgtattctataccgatcacaatttaatctttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgacttttttttttttttttttttttttttgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctgaccatctttaatgcttttaaaatttcatatgaacttgaggtttaccttgcagcaggagttctttccacctgtggaaaattccaattccttaaaagttctagttaacgaagttttagcatgggtttgtgtgtagctactttgtgttcatgtcacattctactgcagccttatgaacagaagggggtatttacatttttatggtgactaggtcttaaaatgagtgggctatcggaagtagaaatctgagctgtacagaaactttttactacaatattatacaactttagagatgttatctatgtaagaaatctgtttctttttgccaacaataatactgtactcttaagttttatattaccagtttggggtttcattcattcatttattttttgttgttgttgtttttgtttttttttgtttgtttgtttgtttgtttgagacagagtctcgctctgtcgcccaggctggagtgcagtggcgtgatctcggctcattgcaagctctgcctcctgggttcacgccgttctcctgcctcagcctcccgagtagctgggactacaggcgcccgccaccacgcccggctaattttttgtatttttaatagagacggggtttcaccgtgttagccaggatggtctcgatctcctgactttgtgatccgcccgccttggcctcccaaagtgctgggattacaggcttgagccaccacgcctggcctcattcatttatttttgggatggagttttgctcttgttgcccaagctggagtgcagtggcacaatctcggctcctccgcctcccaggttcaagtaattctcctgtctcagcctcccaagtagcggggattacaggcatgcaccaccatacctggctaattttgtatttttaaaagagatggggttttgccatgtcggtcaggcaggtctcaaactcctgacctcaagtgatccacctgcctcggcctcccaaagtgctgggattacaggcgtgggccacagcacccagccaggcttcttttatttaaagcgaaagtaatgttcatgctttctctttttttttttttttttttttttttttgagacaaagtctcactctttcgcccaggctggagtgcactggcgcgatcttggctcactgcaatctctgcctcccgagttcaagcgactctcctgcctcagcctcctgagtagctgggattacaggcacacgccaccacacccggctaatttttgtatttttagtagagttggggcttcaccatgttggctaggctggccttgaactcttggcttcaggtgatccgcccatccgcccacctccgcctcccaaagtgctgggattacaggtgtgagccactgcgcctggccctatttttaacttttttcttggtttgtttagatggagtcttgctctgtcacccaggctggagtgcagtggtgcagtctcagctcactgcagcctctgcctcccaggttcaagcaattctcctgcctcagcctcctgaaacattttttaatgacatagtattttaatacactttccacagataggccttaactgattgttccaatgctatctcctggtcgtttggttgagaagtagaatagaaactatcctatatgaaatatttttaagttagcacagtaatgttcttgcctttgactagtttaacatatagtattttttctttttgatcatttgataatggaatatgaggtcttctagggaattgatctaaaataactctttattttaacaggttacttttgatccagaagtatttttcaacatattacttcctcctatcatattttatgcaggttatagcctgaaaagggtaagtccttttgtctttcatatactttgaataatcttaaactcagtgggctttgtaatatttgacacttcagaaatgggctgttctttccagattaccctcctttctcctctccttatcctttttagatgctgaaatttatacctgtacaagaatgctttctcttatttatcctagtgaataatgcatttaatcctagtgaataatgcatttcatattagcatagcatagaaaaccttttctttttcaagtaactggtaagtattctaacagtgtaacttttttttttttgtcagagacatttttttcgaaatcttgggtctatcctagcatacgcttttcttggaacagcaatttcttgtttcgttattgggtaagtattttaagcttaaaatactttgtggccttcaaattataattttaaaataatatatttttgatttatgcagtgttatatattcctgactgggtctaaagacttttgcaatattcacgtaggtaataagttgtttgaattttccttaaggccaaagtattaccatatttcaatgacatgaattaaatttgggattagtcacaaagtactacagtaaacccatcttcttactttatcctaatttttttaacagttgatatttttttctaaagtaggactgtgtttattgaacaggtcaataatgtatggctgtgtaacgctgatgaaggtaacgggacaacttgcaggagatttttactttacagattgcctactgtttggtgccattgtatcagcaactgatccaggtatgttttatatgagtggagtttacatacttgaggtgcattgttttgcagtcaaatacatgtgggtttttctttctttgaggtgtagaattcatgattagatacttccttagtactatactttctaattgtggaggaaaaaacaaaattcatgattccttttggcttcagcacaaatttgttttccttttcctttttttttttttaattacatttgcctattactggtccacaagttgacgctgtttcaacaaggactataaggtactttcttcagaaattcatgttggtctttatccctagtgattgagtatagaagatgaactagattatagattagtttaaatgggtaataattatatatttcctttcaagcttttagaaaaccagttccctaaaaatctttcagtttctattcagctgtatgcatttaacagtaagaaaaaatgtttacaaatgattgttagaaggcagttgtgctaatacaggtttgatttggagtcattggaggactttaatatacattaaagaattgtttttataaaattggctttatgattatacagttgtttgtttaatattaacacaacttgttcccctgtgctttaagtgtcagatcttctaaaagttgtgttccagaatgaatttaattgtactgagttaggttttagttttcctgatagagtattggtaaacttaacagctacattcaaattaggaatttggagaagacacagaatggaaaggttggggtaggaacatagactgatgtttttgaactaaggatggaaattttcttttagcatgctttaagactttcgttgaagctcattttgttttactttttaaccttgtaagttaatcatctttaattgtcatccagcacaattaaaggtagaatcctaaggttatctctgcattcctgtgttaactctgataacacagggctttatgggaaggagaaaaatgtgttcaatactctatgagagatattttggctggacacagtggctcatgcatataaatgccagtgctttgggaggccgagatggtaggatcacttgagactgtgagttcgagaccagcctaggcaacacagtgacaccctgtctctacaaaaaaaaagaaaaaaaatagctgagcatgggagtgcgtgcctgtagtcctagctacttgggaggctgaggtgggaggaccacttgagcctaggagtttgaggctgcagtgagctgcagtgaggctgcagtctcattctgcctgggcgagaagggcgagaccctgtctccaaaaaaaaaaaaaaaaaaaaaaaaaaagattttaaaggattagttagagggccattttagagaatttgtgtagtttagcatttttaaaactggaaattaaattgcttccttaaagaccaccaaagctgtcctctcattgtttgtagctactcccattatcaacatgaaggtaggatggttttggcaaggagccggtggtctctggtttctgtgtcctttcattataagcaaggttctcaacttttcaaatcctatgagaaatctgagtccatgagtccattggcttggctacattatttcaactttctggttttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctgtctcttaaaaaaaattaaataaataaaatgcaagtttcttgtttttatgattggcatttgaaaaggctctctcagctgggtctggtggctcacgcttgtaatcccagccctttgggaggctgagacaggtggatcatgaggtcaggagattgagaccatcctgactaacacggtaaaactctgtctctactaaaaatacaaaaaaaattagccaggtgttctggcgggcgcctgtagtcccagctactcgggaggctgaagcaggagaatggcgtgaacccgggaggcggggcttgcagtgagccgagattgcgccactgcactccagtctgggcgacagagcaagactccatctcaaaaaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggcttcttattaagacaaatccagcagctgtaattctggtcataaattttaccccaaccaaaaactaaacctatgttttcatttcctactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaaaaatatttatataaaattacggggtctttaatatggtaagagaatgtttattaggattgaattctaggaggaaatgaatttctaaataactctcagagtcatctactgaggagaatatgttatatttgtaatgtctaagtattcctctgactctttttacttactagtgactgttcttgctatattccacgagcttcaagttgatgttgaactctatgcacttctttttggtgaaagtgtcctcaatgatgctgttgccatagtgctgtcctcgtaagtgtttgttttcttattatattctgaatattaagtgtgagggtactaggaactgaaagtcacttattgaataaagtacattatgaatggaaacatttggaagaatgaggcatttttttccctcttgaagaaatccatattttatagataaattggaaaatacagggaagagaaaaatatgtactgccaccacctaaagacaattactgtaaacattctagaacatttccttttctatgtatgatattgttacatagttgtgattgtagtgtctgtataattttgtattcggttttaacattacaacatgagcatttaattttttaaattagatttaatattttctttcttttttttttttggagataagagtctcactctatcacacaggctggagtgcagtggcgtgatctcggctcagtgcaacctctgcctcccaggttcaagtgattctcctgcctcagcctcccgagtagctgggattataggcacccgccaccatgcccggctaatttttgtattttagtagagatgggttttcaccatgttgcccaggctggtcttctcctgacctcaggtgatccacctacctcgatttcccaaagtgctgggattacaggcgtgagccactgtgcccggccttaattttttctgaatacataatatattcacgtggctcataaattaaagtcatgtaaaaagttacacacagaaaattcacactcttacatctgtcctcatccacctgtccccctagttccttgtagataactttttttttttttttttgagacgaagtctcgctcctgtcccccaggctggagtgcaatggcacggtcttggctcactgcaacctctgcttcctgggttcaagtgattcttctgcctcagcctcctgagtagctgggattacaggctcctaccaccacgcccggctaatttttgtatttttagtagagacggggtttcaccatgttggccaggttggtctcaaactcccgacctcaggtgatctgcccgcctcggcctcccaaagtgctgagattacaggcgtgagccaccacgcccggcctagataaccatttttattagtctcttacctatcttagtatttctttattcaaatgcaggcacaaccgtgaataaatagtcttatttgcctctcatttcttatttttaaagttacatactgtctatcttctggagaactttgcatgtcaaaagagtgaatattctcattctttgcagctatatagtattctctgtgtgaactgcattattgtttatttgctcagtctcctatagcaggacatttgaagggtttttaatcctttgctgtcccaaaaggtgctgcagtgattaaccttgaacttaccttgttttatacatgtttaggtataatggtaggctgaatgtcccaaagtgagattggtaggtaggttaaagggtaaaatccatttgtaattttgttcgacattgttaaattgctcatcaaagaaattgtagcacttcgcactttcaccattaaattattggtctgtttcctcacagtttcgccagcagaatatttgtcaaacttttatatttttgctaacttgataattgagaaatatctcattgtagcttaatttgtgtttctcttatttgacataatcatttcaaaacatttttaatctctagaagtgttaatatatattatagatatgtagttatgtattacttataccaatttaattgcagacaattttgaatgagcaatattttttatctaattatagaaagtactatacatgttactataaggtgtttgcaggttgaagaatgagtctgaacctctgaggaattcaatcctgcctccctaatcttttttttttttttttttttttttttgagacagagctttgctctgtcacccaggctggggtgcagtggcgcaatatagactcactgcaacctccacctcccaggttcaagcaattctcctgcctcagcctcccgagtagctgggactacgggcatgtgccaccatgcctggctcatttttgtatatttagtaaagacggggtttcactgtgttggccaggctggtttcgaactcctgaccttaggtgatccacctgcctcggcctccccaagtgctagaattacaggcgtgagccaccatgcctggcccctgcctacctactcttattaggcaaatatctaactctataggcagttgcccttacttcataccagaactttctatgagagagaagtaagagcccttcacattttctctttatttttatttctctccttaattttcactttgttagttatgaaagaataaaacatcactggctctgttttgcatagcctgattgtcttctgcaaagttggaaattattatttctcagatgtaacattaatcccttaaacgttgtatgtgaagatatacaaaaggccatatccttttttgtgaatgcaatgtatgtaaatattaccccctccccaccatatttattgccagattttttttgcagctgtctgcaactaatataaatttaacttgagaaataaaacctaaaggctgtaactcatattgatactgaactttagcaccttcaatgatgataggtgcagaataagagttttgtattatttgaagtaagggagaaatggatagtatggttataaaaaatgttataaaaaatgaagcaacaaagattgttgaagcttccagtacgtaggtacatgagcgattaccagcactacaaagtaaagagagtaggtacaggcagtcacttttagcatcgattccctatcctagacaactattctactgttcagtcatcttactagtaactgttgtcttatcattgccctaatggcctaatggattaagagttagaaaatctctgttctggtcttatcttaaactgatgtgccctgtgccttagtttttcctattaataaaattgcctgtttcctgcatctttaggaacagttgattagcgttagaggaaaagataaaaaccctcattgaaagattttgagcttggagttataaataatctatttcctgcaacattaggaatagttgattagtgtgaaaggggtcaaaacctcattgaaagattttaagcttgggggtgtacataccagtgttggtgaagaataaatgctaaaaagagagagccggctgggcgcagtggctcatgcctgtgatcccagcacttcgggaggccgaggcgggcggatcacctgaggtcaggagttcgagaccagcctggccaacatggcaaaaccctgtctctactaaaaatacaaaaattagtcaggcgtggtggcacacgcctgtaatcccagctacctgggaggctgaggcaggagaatttcttgaacccaggaggcggaagttgcggtgacctgagatctcggcactgccctccagcctgagcaacggagcgagactgtctcaaaaaaaaaaaaaaaagagagagagccctttccatagcatttctcacaaagggccatacttcttctcttgcagcctttctcaaacagggttttctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaacaaacgtgataaactgtttaacttcactaattaccagagatacatgctaggatcagtagccatttctacctattcaattaacaagacataacttttttttttgagacagagttttgctctcgtcacccaggctggagtacaatggcgcggtcttggctcactgctacctccgcctcccaggttcaagcgattctcctgccttagcctcccgagtagctgggattacaggtgcacaccaccatgcccagctaatttttgtatttttagtagaggtggggtttcaccgtgttggccaggctggtctcgaactcccaacctcaggtgatccgtccgcctcggcctcccaaagtgctgggatgataggcaggagccactgtgctcggccagaattgttaatgataatgacatagtacagtcattcttagccaggggcaatttgccaccccctcaccacacacacacaggagatatttgacagtgtctgggggcattttggctgtcatcaatgggggggggttcctattgacatggcctagtgggtagaagttttcaatgcacaggacagcattcccctcaccccacccccatcacagccaacaaataaatacctggccacaaatatcaataatgctgtggttgagaaaccctggtgttgtaaaactagaccactcatacattgttaacattgaaattggtattaccttttatcactatttatgataatgttaaaatatgtttgtggcaaaaatttaaagcatttgactcaaaaagtagaaaattcctgaaatttcagctcagaaataaccactattaggattttaatccagactttttccgttaagatagtagtatacatataaatatgttaataatctttataaacaataaaggcatagtagtatatatacttttctgtagcttttttacttggatattatactatattaatacctctattatcacattgggtggatgcattacaaatttacctctccaatcccctattgattgattaatatttggtattttctaatattgtattatgactagcatggcagtgagcatatttatgtgtaaatctttgtgaatccttgtaaatatttctgtagggtattttttaggagtagaattgctaggtcaatggtatgatcattaaaaaaattgggagatattatcatatttccctccaaaagtgtaatggagaccttttggaaggcagtggagcaacatgtaaaatgagccataggtatagtaatagtctatttttagaaatatagtgcaaggaatagtctaaaatatataaaaagcaagaagatgttctttcagttatttatagtagcaaaaatagtagaagcaactttcaaatgtctaacaatgaggaaatggttgaataaattgtgctgtatccatttggaccattgtgaagtcttaaaaactgtagttataaagactatgaatttttttttttcttgagatggaattttgttcttactgcccaggctggagtgcaatggcatgatgtcagctcactgcaacctccacctcccgggttcatgaggttcacctgccttagcctcccaagtagctgggattacaggcatgcaccaccatgcccggctaattttgtatttttatttttagtagagacggagtttctccatgttggtcaggctggtctcgaactccccatctcaggtgatccgcctgcctcggcctcccaaagtgctgggattacaggcatgagccactgcgtccggccaagactatgaatatttttatgtcattgtcagttaaaaaagcataattcaaaaccacacattcactgtgattacagctaaataagaattagcatgcatgtaacacaaagaggggaaaggaatacagaaggaaaataaaatcgatctatcagggtagtggaatgatgggaagatttttccacctaaactgtacattttattactttcagggtttaaaaaaaagtattcataaaaaatgctactgcctcaagataaaatatcaattgatacagaaaagatgagttaagatttcaatccagaggctagtgtctgcctaagagagaacaaaacgagcctgtcatctgttctcagcccatcatgtttcccatgtgtccttatacattttaatgattaaagaatgaaataatgattagtgtgaatcttgaatttacatgaactaatccagggaaagcaacctcaggaggcatggcataggtattttgttccagagagcattttgaaaaataccaccaaagaaaaagaagattgtatagcaatttttttcttttctccagccagttactgtattttcatgttataatgaaatcagatctcatttatggtagtgggaccctttatatatatgtaggtaaggtagcatggtgttaaaggccatttcatatttatcaaaatgatatcaaatctactgttccaaaatgatctggttgctttgcacatttaaacgtaaatgtttaacattttcaatttagagtgagtctcagaaatttctggatcccattatcagaaattaatattagtgctatatttcaataaaataagtacaaattaggagattttagtttgatcttagattttttttttaacctgggagatatgaaaagaacttgtatatggtatagcaaacatttttcagccttgaatcagaaaaaaacattgcagcaaccacagggagaattcattatatttttaggaatgtgtttttccttcttttctttgacgtgatttgtatgatgttgttgagtctggactttttataatgctggtctctcaattaactgagatgagaactgatttagtaacggtaagcaccgttgccaaagacctgctggcaacagcaattttctcaggcatttctatttcctggggtggtaactgttacaaaagaagctttttcagaccaggtttggactgtgagttcaagatggagagcatctcctataattgcctgtcttggcctggtatagagtgactttctttcagaagtttgaggtggaagatccagctggttatgctgaaagtactgttgagtggattctaattccttgggaggtctttcgagtgctttttcctataatagtccatttcagtgaatgaatagatattaggcatttggcccattctagaattctaaaagttggaagggtccttcagttacctttttttctcataggaaaaacaaaatgtgactgggttgagtattgaataatgttctttatgttcttatgcctctactggaaacaagtgggatttttcattagtttgttcacattagtatgttaaggctttcggacactcagtactagtaattctgaaacagaatcacaaaagaataatactgcacagtatcttggggatgggggaaaaagcttggtgcaattttcatatagaggattttacaatgttctaccccccccccgaaattaacatttaagggaaagccaagttttcttgctagccagatacattgcaggatttttgggtaattttgtccttattttggcaattccaatcgaaagcttgtttttcttctccctctaatttcatctttcaagctctatactacataatgtttttttaaaagtaaaggttgttttcagaagtaaaagcagtctctcttctgtagctcaatagtggcataccagccagctggagacaacagtcacacctttgatgtcacagcgatgttcaagtctattgggatcttccttggaatcttcagtggatcttttgcaatgggtgctgctactggagtggtgacagctttaatatccttttgttatatttatcttttcttgttaacataatatagtagttgaatgctgtattccgttgtttttcctagttctatgattagaattatgttagaattattaatcttataactaagtacttggtttgaaaacattaagcaacagtctttgccaataaataaataaaagaactgtattgttctgcatagggtttggtgccctaaaactttcactgcaagtgtataattagagatgatatctctctgagggtgaattttatagttgtagattaaatagctgtaaaggtagacatattccaaagagcctctgggtgttctgtgttgctggtcagcctggcagtcttttgctctttgtttaataggacaaataggaaatgtacaacagcgacgccgaatgaacaaaatgtgtttccttggttaggatatgtaagagttcatctcagctctcccgattttaaactttgtgctctagagccctggacgggaagcccaaaggacctgagttgtagtcctggtactaccacttagtcaagttattcttgtgttcatgcaaaggccattttatcccggacttcaccaccatgcaatatatccatgtcataaaactgcacttgtgcatcctgaatctataaaaacaaattttatttttatttatttatttgtttttttgagacggagtctcactctttcgcccaggctggagtgcaatggcacgatctcggctcactgcaacctccgcctcccgagttcaagcgattcccccgcctcagcctcccaagtagctgggattacaggtgcgcaacaccacacccagcaagtttttttatatttttagtagagatggggtttcatcatgtcggccaggctgatctcgaactcctgacgtcaagtgatccacccacctcggcctcccaaagtgctgggattacaggcatgagccaccgtgcccggcctaaaaacatgttttaaaccccccacccaaaacaaaaagccagaaggcatgtctggatcacctgctacatgtgctgtgctctgtgtatcaaagctaaagaagacaaacatgacctctgcctccctggtgctttcgatatagtggcagacacaaacatgctagaagctttgacacttcacctctttggatctcagtgtaggaaattggagggtggggacggtaggaaagaggagtgggactagatgatgtctaaagagtttccagctctggcctggtgcagtggctcgtgcctgtaatcctagcactttgggaggccatggcgggcggatcacaaggtcgggagatcgagaccatcctggccaacacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcaccaaattacgggagttccagttgttggagacaggcctgttcttcttgatgtcctggagtaccttcctcttggctgaagcatggggcttcacaggtaggtgacttgctccctttgattgtcaacccttaaaaggagtgactttgccagtcaattttgctccaagtggatcagctccgttagtatttgaacatacttattgtggttgggatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggcttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaactactgctgtgtgacgtagataaggttaacttctgatctgaccagacctactaagagatgacataaagaaaattaacttctgatattactagaccttctaagacatgacataggtaagattagcttctgatctgattagacctactaagagaagataaacttccttcagtccgctcaggtgctgcaaagctactatgtttccaggaatgtcaggggactagtcagtggtctggttttatttggtactgaatgatcagttgtgcagggtatctgaagggaattataaaggagataggaatacaatttttccagtcttaggaggtatgtgggacaaatacatgaaaaaagtgtaatgtctggaatagaaataggtgcatacttgattatggctatagtgagaaacagaaggtttaaattttgccaaatgacaagaaggttgtgggattcgcctgaaaaggagtggtgctaaaagcaggagcaacagtatttcttcttccggctagagccacaaatcaagtttatgacctatgcttttccccagcccctcaaaagagattaggctttttcccccaagtgtatacattagggctacaaatcctttttacaaattaattcagtgcaataagtaaagagaagaaaatcagctggcagggggcggtgggggaggggagtcagcatttttccaggtcgtgggaagggaataaaaaacaagaacaggccgggcgctgtggctcacgcctgtaatcccagcattttgggaggccaaagcgggcggatcacccgaggtcagaagttcgagaccagcctggccaacatggtgaaaccccgtctctactaaaaatacaaaaattagccggatgtagtggcttgcgcctgtagtcccagctactcaggaggctgaggtagaagaatcgcttgaacccggaaggcggaggttgcagtgagctgagatcgtgccactgcactccagcctggatgacagagcgagactctgtctcaagaacaaacaaacaaacaacaaaaaactagaacagggtaagagcttccagtgttgttggtgatatgatatgaagcttatgtacatttaagaaatatgaggaataggaatcctagattatgtacttcagattatatgtcatagaagacatcagagaagtaggggaaatggtttgaggcttgaggatctggaaagtatcctagaagaaacagtacccttagaaggatggggaagatttaggaaggcctaggggaggcagtacagataaaggcaggaataaaaagaaggcagtaaagtgtagagcagagggtggcggactccagccctccggccacatccggcccttgccagtgagctaagcatggttttctttccatccatttttaattggttggcaaaagatcaaaagaagaatatgttgtgacccatgacagttatatgaaattcacatttccatgtccaccaataaaattttcttggcacacagccacacccattttttaaaatatatagtctatggctgcttttgtgcttcactggcagagtgaagtagttgtgacagagacttcttggcctgcaaatcctctcatgtttactctctggccattcatgggaaagtttgccgatccctatgttgcaaagtaaagctgggactctggagtcactgtattgttttaaatcctggttctactacttgctggctgtgtgaccaggaggaagttccataacttctctgtgcttcagttttgccatctttgaaaatggagataataataatacctacctcactgagtttttgtgggattaaaacgagataatgcatatgaagtccttagtatagtatcagacacacggtaaaaactgaaaaaggtatagctgttatcattagtataaataagtagtaataatagcatattaaatcatttaaagaaaaataaatatacgcttacttattttaatttttattctcatttttgggtaataaggcaaccctggtttaaagagattaactaatttgcccaaagccacacagccagcaaaggggaagacagggctcaagcctaagcattttcattcttaagcccatgttcttaaccactattctgttatgtgtcagagggctcattgtagataactctggtggccagagggacacgagattatgaagggccttaacttcattcagcaagtatcatataccattgccaaggctatgatgtgaatgggatggggcaggcgggcagcagggtttagttccccccacagatagttctgctatcctacagatcgatctcttccacaatgtggaagcccctatctgtaggacgcttactccctatacgagaggaagacccacgcaaaaagtgaagtcacagggcaagctgggagtacgagagttctcacgaagcactctatgctaggatcagaaagttgaaatgaatcttatagcttgcaagaggaaagtatcttgaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagaccccatctttacaaacaaaattttaaaaactagccaggtatggtggttcatgcctgtagtctaagctacttgggagggtaaggtggaaggatcccttgagcctaggagtttgaggctgcagtgagctgtgattgggtcactgcagtccagactgggtgacaaagggagaccctgtctcaaaaaaaaaaaaaccaaaaaaccaaaaaacagttggaaggaagaaactgagtatatgaaagagaggaggcaatagtgaaagcctcttgagaaggcaggaatgaaatccaaagcatgtagagagaaattttgccttcactggaaggagagacaactccaccatgactacaggagaggatagggtatgtagaaatgaaggcacatttgtaagatggagccatcctctctgatggcttctatgtttatctgttaagtaggaggtgagatcatctgctgagagtaagatagggagttatctattgtgtaacaaattaccttaaatttagcagcttaaaacaacagacagttattatctcacacagtttctgagggtcaggaatcctggagcagctcatctgggtgattctggctccaggatctcttaagaggtcgcagttgtgctcttggctgggactgcaccttctcaagacttgactagggccagggaatccactgcaagctcactcaactcacatcactgtcagcaagaggcttctattcttcacgtggatatctccatagggcagcttacaacatggcttcttcccccaaactgagtgagctgagagagccctaaaatgaaagccgaagtgccttttgtaacctaatctttgaagaggcataccagcgtcacttccataatattctgttggttatacagaccaacctggtacagtgtgggtggggactacacaagggtgtgaatactaagaggcagggatggttagggactatcttgggggatggcttacacagatcatagggattttgaggaagatggaggttcgtgaaatagttgttgtagagagtgggagaataagttgaccaaagaaactcaacaggactgctaagaagtactagggatccattgtgtttgagaaataggaattagcagtagaaccaatctgccccattgaatgagtttgtccagcagtacttactgtaagcatggaaaaaagagatagttggctccttccaggtttggagttttttcaagtgggtgcaatgaaaacagaaggacaagagatcatagtgttattacatgactgatgcactctaaacacttcatttaatgtttaacattaaaaggtgttattaacatgatgataagaagggaagtgaggaaagaagacattgtttaaggaaagaatatagggatctttggactgaaggtcccagtgctatggaggaatgatcagagtgggatagttgaacacaaaatatggaaggagcaattgtggtcagtgggaatgtttgaataaggaatttttaaaagaaatattttaaaacctcacatcagaatgaagattctgccaaagagattagtggaagtttttttttttttaattaaaactctagataggatctctgttagaaagcgaagtattactgaaatactattctgcagagccttagtctgtgaatgaactttaggcaaaaaagataaagtactgttaataagagaagttcttagctgaaagataaccatgagatcagtaacttaatgtcctgctagtcttggagaaaatttggagcagtaaagtggctcgatccactatacttagtctggaaacaaagctaaatattctctgtaggtttctgagtctgttaggaattaaaattcctcaatacaaaatcctaccatgaaaatggcctcgtaacaggagagagttgctctatttctggctatgttagttaggacataggttggtttcatgtgaaaagactcaaactaatccaggtttaaacaacatagaaatttctttcttatctaaaaatctgaactggtatggcagttctgctgcatagggtcatcagggactgaagcaatattgttgctaacatccttagggacttgctgttgttcttgtgatccaacgtggctcacccctgtctgcccgttgccttgaagggcttgacccagaatgtgcacacgtcccttccacttaacatcattgattacacctactcacaagggaggctaggagttatatactttatctgggtggctgcataaagatgaaagggaggagtgccaactaccaaggaagaaagcaagaacagatgttggggagaactagcagtcactgccacgttggcccacatgtttcgtggttacattttcttttctttttagggaatcactttttaaaataaatgtttgattttagaatagttttaggtttacagaaaaattgtgaagataatacagaaagttctcatatgccccgcactcagtttcccctattattaacatattagcatggtacatttgtcacagtgaatgaactaatattgatattactaactaacgtttgaactttattctgattcccatagtttttccctaatgtcctttttctattccagggtcccatccaggataccacattacatttagttgtcatgtccccttaggctctgcctgactgtgacagtttctcatatgtgttcattgtttttggtgacccttgacagtgttgaggggtactagccatgtgttttgtagaatgtcctgcagttggaacttgtctgatattttccccatgattagactggagttacatgttctttgggaggaagaccacagaggtaaaatgccattctcatcacattatatgaagggtatatacttaataatgttgacgatagtcttaatcacttggttgagatagtgtttgtcagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccgcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcttcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtagatatatatactaactcatatatacacatatatctatacatatttctgcatataaccatctgtatctctgttaagctcaatatgggttcatactgatgtctccaactttaattcattaccacatggatgattctggcctcctcctctttctgaactgtaaactcccattctaacagtaagaaaccttgttgtcaccacttgccatccatttacctaattgttcagtttcagtatacatgtataatagtttcagaattgttaaccagtgttcccatgggaaacagctttgtcatgagcatagaatgcttttgtgcagtgtcttctgtctttagtcttacagattcttctgttttccaaagttacttagaccaacaccattccccctaccttgtttgttttgagacagggtctcgctcttgtcacccaggctggagtgcagtggcacgatctcagctcactgcagcctccatctcctgggttcaagcaattctcgtgcctcagccaccagagtagctgggattacaggtgtacaccaccacacccggctcatttttgtatttttaatagagacaggtttttgccatgatggccaggctggtcttgaactcctggcctcaagctatcctcccgccccggtctcccaaaatgctgggattacaagtgtgagccaccatgtctggccttgttctgtttttaatcttagattttcccttatatttttctcaggaaatgggatggagactgtatcgtgactcctgaaataaaaattgccatcataaagcaggagtcccatagacagcaaactggagaaaaagatactaaaattggtttctagttaaaaccaatctgaattcacattaaactttccctttgaagcaagttggaagtataaacttagtggagtacagtgggactggtagccattttagtgctgtgaggtggtgattcagctgcccttttctttgttctgaggaaggaaggggaagttttctcagtattactcttcttcctaccaacactgacaatgaaagtgaattaacctattctattaataatcttaaaagtatagtaaagaaactgcttttaaacgtgtttctcttaatctagtaaatttcctgcatgttacacttgctctgtctgatttggtagcaactagccaaatgtgattattttaatttgaagtaattaaaatgaaataaattttcagttccttgatcactctagccacatttcaggtgctcaccaaattggacagttcagatatagaaaatttccatcattgcagaaagttctgttggacagtgttatgttagacaatggaaccaagagactgtgtgttagaaactgagttccctaaaatagtctttcaccatcttgagtgtatagtctaaataatattaatagtaaaatgaaatgatccttaacctattaataattttaggttgctattttcttgggaagagctgccaatatttaccccttgtccctcttacttaatttgggtagaagaagtaagattggatcaaattttcaacacatgatgatgtttgctggtaagttgtaactttcttctcttgcccacttcaagcaaccattcacaatgcgtgtgccagcttgatgtaacactgagatgttatgctggtcatataatactcctttatttttatattatttatttatttagagacactgtttcactctgtcgcccaggctgtagtgcagtggcacgatcttggctcactgcaacctctgcctcccaggttcaagcaattctcgtgcctcagcctcccaagtagctgggattacaaggcatgcaccaatatgcctggctaatttttgtatttttagtagagatggggtttcgccatgttggccaggctggtcacgaactcctgacctcaagtaatccacccaccttggcctttcaaagtgctaggattataggcatgaggcaccacgcctggcctataatactcctttaaacattgaagttgcatccttgaatagaaaaagaaaatgtatatatatatatatatatatatatatatatatatatatatatatatatatatatatatagtgtcccattcccttctgtgggaatttttcatattctgattccaaatccttggttcagaattatgtcatacaaagtgagaaagataaggatgaagtcattttcaaacaaaaaccagtaggtgaatgtatagcagttcttttcataattgccaaaacctggaaacaacccacttgtctgtctctcagtggtcaaatagctaatcaaactgtgatacatccatgctatggaatactactgtgcactaaaaagaacaaacaatttacccatacagcatggatgaatctcagaggcattatgctaagtgcaagaagccagtcttgaaaggttacctgctgtgtgattccctttatatgacattcacaaaaagacaaagtcgtagcgatggggaatgcatcagtggttgccaggggtttgatggagtgacaagaggttagactaaaaaagggtaatacaaagaaatttgacagggggagggatgatgaaaccattctgtgtcttgattgtagtagtagtcacacacacctctatgaatttgccaatattcatgtggctatagaccaaaaagagtgaattttactgtttgtaaatgaaaagtgaatttaaaaaaattactgaaacatcaatgcatgtcagtaagtaacatacacaaattctatttctgtttgtactttttttttttttccgagatggagtcttgctctgtcactcaggttggagtgcagtggtacaatctcagctcactgtaacctctgcctccctggttcaagcaattctgcctcagcctcccaagtagctgggattacaggcatgcgccatcatggctggctgatttttgtatttttagtagagatggggtttcggcatgttggtcaggctggtctcgaactcctgacctcaggtgatctgcccacctcggcctcccaaagtgctgggattacaggtgtgagccaccatgcacagcctggacatatttaagtatgttaatatttactgcatatttgttcacatgcttctaagtttttagaacgtgctttcttgctctgaatttatgaagcttgcattggtaatgagttattgaagaaataccttttctgttcccctgtaggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcaggtaagtactaactagagacctcattttaagattaaattttaatttggtttatttttctgcctgttttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaaaccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatcatttttctcatcagcactgtttttaacctaacaatccaaagccgagatcgtgaggtcttagtcttgaatgtgtaccagttaatgtattcaatttgaaagctcccttgtatctcaagagttctgcatttgtttccatggatacagcagcctatgctgctaaagcctttgtagatttgagttctgtgtttggctgaaacttcatagacattaagagctaccaagcttccagaatacataggactcattagagaaaacagtatttcacactttatagatcctgtcctccatttttttaaattctattacaccttttttaagacttctaaaaaccagccagccctaaatcacactttgaatgttgttgttattgtcttaatttctctttactattcaaatctcttataatttctgtgcttttattgtgcatagtataaaatacacaaaaataatgttcttataaccttaattattactttagggaggacctggcatttattgaacacttactatgtgctgggcattgtgctaagtacattttacatatttatccaaacatgataactccattttacaagggatgaaatagaggcttagaaaggttctgagttgttcaaggtcatctggataattaaatggcaggcagaggagcctccagtctttcttaatttttttagaaattaatttcatcaaataatggtcatggtacattttgaaaggacacagttcctttcttttctcaagagcttgtagatgaagactttccctcattgtcctaaggataacaaaattaaatgtaagaacaaaccaaacaaaatatctacgcttaccatccccgcaaaaagaaaagacaaaaacgtacctactcacacaaaatttaatctacatcactagctgtcaaagctctttggccgcatagtgcctgtcctgtaacatagttggtcacttaattataatattgtcttatagtcttaggttacttcttattgccttcttgttttattggcattattcttggcctcttcgtgaacaggggctgtattttaagcttttcttccctccccccaaatttgtctagtacaattttaagggcactgcaaagtcctgaaagtttaagattcatgcagacttagacttggctttgagttcttgccccttcactgatgaattctgtgatctttggcaagttctttaaccttttaaagcctcggtttcctcatctgtaacatgtatgttatagtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcaccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaatgcataggacaggctcctcaccacctgccaacagagaattatctaggccagaatgtcagtaatgctagggttaagaaatcctcctctagagaagcacagtgatcaaaataagatagaaaaggttcctcgactcataacatccatactttagtgagagaagacagacaataagctagtaacacataaatgaacctgataactgcagatgatattaaatgctgtgatgggaatcgggcaaggtactgtgatagtgactggggatgggggtgtttttgatacaaggaggccagggacggtttctttgagaggttatgtttgagttcagtcttacctacgtgactagatggtgccagttaaacagtcatcaggaagaagagcagtctaggcagagggaagagcaagttgtacaaatgtcctgaggaagggacaaacttggcctgttgaatgaacaggaaaaaaactctcatggccggagtatagtgactgaagggtagataggaagtgaggttggcaagatcctatggaagcaggggttctgcacacttaactgtcaagggccagagagtaaatatatcaggctttggaggccatatggtctgtctcagctactcaactctagtgtgaaagcagccctagacaatatataaatcaattggtgtggttgtatcccagtaaaactttatttacaaaaacagaagaggtgctgatgtggcctgtaggctgtactttgtggacccctaatgtatagtcttgtggaacatggtaagggatttggattttaaaatacaattggaaatcctggaggattttaaagcaagggagtgacatgaagtcatttacagtgtaaaaggttcactttagttgtcatgtgaacggtggatccacagtaaatttgaaacagccagctattcccatgtcctttcacatagtttgtgacagtcacatttctatcatttactacacatgctttgcacttctgcgtctctgagcctttgctcatactgttccctctgcctggaatgctctttcactgtcagtaaatgacacagctaagtgccacctccttttccctctgttcttttccctcggaaccactcttatgttggtgcaacattgggcctcttcattgtagcacttattttattcagtcttgtgataatattgttataagagctgccacttagtgttaatgtttcagatactcttttaaaagcttttcatacattttctcattaaatccttgcagcaactctgtgtggtggatattagccccattttccaggtgataaagtgatgatttataagactgcctcacttgactgagttcacacagctagaaagcagccaagtccagatttgaacccagagctccctgatagaagcccttagggattatgccctagttgtgttggtttcccccactagtctgtgagttccttgagggcaggggccatgtttaattcatttctatgccctgtgcctagtacagtgcctggcaaataataagtgctctataaatgtttattacattgacttagcttctaataatgtaccatctattacaagtgtgctatcttcaagaccactagatgtcactggagatgcataaatgtggttagagtttaatgtgactgagaagatgttaaaacagctcctggccattttaacaaaggaaaaatgagccattctttgaattatgaatctggtcatagcaatctgttttcaggtccttgaccatggttcccttgctttccagatgcagccttgcatcattttctcccttcagtgttatttgtgttctgggatgctactgctacagcttctagtactgctattttttctgtgttgtctgtagtagttaatttaatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattccatgggcttgacatacttgtaaaaaccaagctggataaattcccatgatgccgggctcctggtgtagtgtccaaggggtgataattcctcagtgcctcctccctgtgtgaaaacaagaataaagttaatcatgcagttcaaaagacaaatgctcgatcactgtgtaagtctccaccagctgtgtcacctgtgtaaccacagaggagaaatggaaaaggagtgacagggagagagccaggtaggtgagtgccagtcgtgacatacagaacaaaggaccgttttttttcccataccttcaaaaccctatggctgggccgggcatggtggctcacgcctgtaatcccagcatattgggaggccaaagcgggtggatcacacgaggtcaggaattcgagaccagcctggccaacatggtgaaaccctgtctctgctaaaaatacagaaattagctgggcgtggtggtgggtgcctgtagtcccagctactcaggaaactgaggcaggagatcgtgccactgcactccagcctgggcaacagagcgagactctgtctggaaaaacaaaaacaaaataaaaaaaaaacaaccctgtggctgtcttggttatattgttcctttaatattttgaatgtccacgagaaagcacagaggaaccttatactaagtatggagtgtgtgggggtggggtatacaggtgttcatgtggtgaggggtggtgaaatgttgttcttcaagaggtggaggcacagaaagatacttctatgatgtgaaaggaattgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaaaacatttcaatttcctattccaaagctgcaatatacaaactattaaatttctaatgttacccttgttggagagtgtcttataatatagtagcctctatttctgattctccaaaggaatggctctaaataaatgttcatatctttgtatagatattgatttctgtattatctatctgcagggtgttcctgaaaatgaaaggagaactaccaaagcagagagtgcttggcttttccggatgtggtacaactttgatcataagtatccttaattgagggaaaaaaaaaaaggataatgtggacatagataattacagtttaatggaacaagtgttttgactattctcttcctggagcagaatataaaacctacctttcatcttccctttccccatcagtgctgtggaaaaggaaacccacacagacagattcctcttcaaacccatgaaaccgtagggactggtcatttcagaagctggctgtgtaaagggaaccaaagcccaaatgacatactttctttgatatataggtttatttattgagcaaactttaatatttgttgtcctttagctaatttagtgaatcccacagaaggtatttcttggttcttgtctgcgtacttggcagggtaagagaggaaaggcttgggaaaaagcatgagaatgaaatcaaaatgcgataatgttcaatactgcgctgttcagcaatacacttttttttcccctgacctttccaaagactaggagattctctctgttcagcatgccacagatagctaatgtttttgtttgccagatttccttcttgccctgttgtaagtctgtttcatagctgtactttgagtagtgttgatattctataacctctttaaatcagggatccccaactcccgggccgcggaccagtactggtccgtggcctgttgggaaccgggccacacagcaggaggtgagcaatgggccagtgaacattaccacctgagctccgcctcctgtcagatgagcagcattagattctcacaggagcccgaaccctgttgtgaactgcacttgcgagggatctaggttacatactccttatgagaatctaatgtctgatgatgtgaggtggaacagttttatcccaaaactgttttgttcccagcccagtccatggaaaaattgtcttccacaaaaccggtccctggtgccaaaagagttggggaccactgctttaaatcatgccttttaaacattttatcattattaaaattaatttcttatttgaaaattcacctagcaaaaacagccatggagttctttcaggctctgatttatcagtaaatgattcaaaacttggtttatgttctattgaagcaaattggagacaaccgtgtaagaaatttgtccttgctttcaactttctgatgaaagccttgtatatttaagaaaaatcacttgacacttaatgattagaagctactacttaccatgttctgtttggtaatttttgcattcactgcttgcaagtacttcaaaattaaattattgtatggaaacaagaatgcaagcatatctggggtattaagactcccattagagaaagagagcctggctcttaaaattttttaaagattatgtcattacttttggctccattgtcagggttttggatataagccactctcatatctcttggggctttttcatccctctaatttagcaataattttttagtgagttttctgcataaaatgttttgtacattttctacataatatataaaacagttcaatgatcctaatgttgagaaagcgtagaataatagcttattcttctgtatattttatggaagtaaacaccaaggcttgtttgactcagtactgccctattaagtcctactcaatgaagacctgatcattttaatacctagtgccctgatataattaaatattcattattttagatttcagttcatttgtgtaggcaaatgatttgttataattgagctataacttgaatacaataaagtacacgaatcttaagtgtacagcttaatgaatttcaacctgtgtcaacaactgtgtgcctcccacccatacaaagatacaaatgaacattctctatccccctccacaaaggggtaaccatgattctgactttcatcaacatgggttagttttacctgattttgatctttatatatatggattcatatattaggtattcgtttctgtcttgcttctttcactcgacatctgtgtaatttatccctattgtttcatgtaacagcaattcattctttttttattgctgtagtagggtagagctctgtagtaggaatatactacaggatttttgtttgtaaccagtctactgttaataaatatttgggttggttctagcttttggctattacaaaaacctgcatgaatatatatcttttggtggacatagcactcatttctcttgggtatataccaaggagtgcaaagagtggaatttaggacaagtatatgtttaacgtgttttttgtttgtttgtttgtttgtttgtttgtttgcagtagtgtctggctctgtcacccaggctggaatgcagtggcacaatcttggctcactgcaacctctgcctcccaggctcaagtgatcctctaaacacagcctcctgggtagctgggactcctggtgcatgtcatcacacccagctatttttttttttttttttctcaatgtagagacatggtttcaccatgtttcccaggctggccttgaactctgggactcaagtgatccacccacctcagcctcccaaagtgctggaattataggagtgagccacttgcccagcctgtttagctttaaaacagacattgccaaccaaccagttttccagagtgattgcaaccagtttaattggttttaaccaacttggtgaatttatgattatttccatcagcaaattaagggagttctatttttcagtcttttaaattttagccattttgatgggtgtgtagtgatatctcatatggtttaatttgcatttctctgatgaccagagaggctgagcaccttttcttgttttttgaccatttagatatcctcttttgtgaagtctaagtctttcgtccattgtttaactgagttgtttttttctctcattgatttatagttctctctatattcctgaattgggttttttgttgttgattattgtattttttctcagtctgtagcttgccttttcattttcttaatcctgtatttaaggagtagaagttcttcaatttaatgaagtctattacattttgtttatttttaagataagttcccactctctcacccaggctggagtgcagtggtgcaatcatagttcactgtagccccaacctcctgggctcaggtgatcctcctgcctcagcctcctgaatagctaggactacaggtgcatggcaccacatccagctagtttttaaaagttttttatacagacaggttctcactttgttgcccaggctagaagtccattttattcaccttttatggttagtgttttctgtgtcttaagaaatcttccatatcccaaggtcgtgaagatattttcctgtttttttctagaagtatgattgctttaactatcacatttaagtctttgatccatcacaaattcatttttgtgcatggtgagagatagtgggtgaagatctacttttttccatatgcatatccagttgatgcagcaccatttattgaaaaatatcatccttaccccactgaattgcagtacaatctttgttgtaaatcacttggctgtataagtggggataagtttctggactctcttttttaatcctgtttctctatttttatatcaataccacaccctttttattactgtactttataataagtcttgctatccagtagagtaattaaaatctggctttgttcttctccagtatagccttggctattttgggtgctttgcgttttcctttaaattttagaaacagcttgtcaatttacacacatgtgcatgtgcacacacacgcacacacacaactgctggcaagtttattgggtttgtattgaatccataaatgaatttggagagaaatgatatcataacaatattgagacttccatatcataaacacagcatattgctccactcatttaggtcttttaaaatttctctcattaacgatttgtacttttcagtacacagctcttgtacattttcattagatttattcctaagtatttgatgtttttgatcctattgcaaatggtatttactctgttttatacttgtttgatgtaaatatatagatagaaaattggatatttatttatttatttatttatttatttattgagacagagtctcactctgttgcccaggcaggagtgcagtggcacaatctcggctcactgcaacctctgcctcccggattcaagtgattcttctgcctcagcctcccaagtagctgggactacaggcgcccgccaccaggcccagctaattttttgtatttttggtagagatggtgtttcaccgtgtttgccaggatggtctcgatctcctgaccttgtgatctgcccgcctcagcctcccaaagtgctgggattacaggcgtgagccactgtgcccagcctaaaatttgattttatatatggaccttgggtccagcaatcttgctaagttcacttatgatttctaatagatactttttggtcttctatatacataattaaatgatctatgactaattatttttttttcttttccaatccctgtatttcttttttgtgtctttttacatcagcttttttaggggacttcttcagtgcaatggtgaatataagtgatgatacaggacattcttaccttattcctgacctcagagggaaatttttcaatatttcaccattaagtacgatgttagctatacgtttttggatatatcctttagcaggttaagagcattctcttttatttctagtctgctgagagtttttatcatgagtttttgtctgctgagaatttttagtatcagatgctttttctgcatcgagatgatcatgtgtttatatttttcttctttaatctgttattttgattttcattgattgattgtttgaatgttaaactagtcttgcattgctggaacaaattccacttggtcatgatgtgttatcctttgtgtatatctctggatttaatttgctaatattttgcatctgatttttgtgtctatttttatgaacaatattggcttgtgattttttcttatagtgtccttgtcaggtttctataacaagattaagctggcctcataaaatgaatcaggaagtattccctcattttctgttctctgaaggagtgataagattagtgttattattatttttttttaatgttaggaaagttttaccagtgaagccatttgagcctggagctttctgtaggagaaagtttttaatttcattaataaatacaggactatctaggtttttttttctttttttttttctttttttaaaaccatttgtcatcatctggcgagtttttttttctaaggaattttttcttgtagagtcaaacatcaagacttgttagcctcagtactacccattcagtaccagaagatgaagacctggtcatttctttactcaaaatgctagaattcatcattccagttttttagtagctttgtgtttggccagatgttttataaagcgtgtttatatgcagtgttttaatctttacttagaatttattaatatgaggattcatgaaattttctctgactttctcatttttaactgagaaccaccttagggtctcattttagaaaatgaggagggagggcatggaggctcatgcctgtaaacccaacactttgggaggctgaggtgggaggattgcttgaggcaggctcagttcaagaccagccctagcaacatagcgagaccctgtctttgcaaaaatcaaataaaaaaaaattagttgggcattgtggcacgtacctgctatgatcacccactgcactctagcctgggtgacagagcgacactgtctcaaaaaaaaaaaaaataaatgaataaataaataaagtggggaatttgtgtgtctgtatccttttctcctttttcttgtgattccctcttttttcttctgagtgtcatatattctcatgtctatttttattttttggcaaataaatgaatactgaaatgagggcctatgataaagggcctcatgatacatagttttttaaaatgtcttgagatttgacttgcctttccttcttatagcttcctaagtaaacagtcagtctgatactgaagtttcaacttataccatgcaagaggccagctgaattcacaataaatgatgaaaaccattttattactatgttctactggaaaatttaatttcctctctggccattaacattgtttactttctcccttatctcctgtagtgcccaatttacagtgatgttccttttggttttagtaaaatcagaaaagcaatgtgatgtagtggaaagggcacaagatttgaaattcagaccaatttgggctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagcgggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatcgtgcctcatcttactgtgggtgattttagtaaatagttctatttccctgctggctttcatttctttgcagtatgtgtcctgagctcagcactaaatgtgtatgctttcctccacaaatgagggttgtctcagttacattttgaggattttaaaacaattttgacatccctaaagtgcaacagatggtctattatttcacacctcccaacctttggatgtttgggaaagctatctgcctctgttccacatttctgggacacatgagcatatctagatagaatctgaattccatattttttccttagctaccaaaatgtgattggtaatttgataaatattgctactaagaaaaaaataacagaaatcctagctgacctttgtttttaaatgtgcacgtttttatttttcaagttcttttttaaaaaccttccattctggccaggcgtggtggctcatgcctgtaatcccagcactttgggaggccgaggcggcagatcacctgaggtcaggagttcaagaccagactggtcaacatggcgaaacccagtctctaccaaaattacaaaaattagctgggcacagtggcgtgcacctgtaatcccaactactcgggaggctgaggcaggagaattgcttgaattggggaggtggaggttgtgagcagagatcatgccactgcactccagcctgggtgacagagtgagactctgtatcaaaagaaaaaaaaaagaaaaagaaaaagccttccattctaaacaaacctttcagaaataatctatgacatcatataggctcccctgttaacaaagcccaccagttttgactacttaggtgcaacacgcagaaccttgagaggggaagctgtagtgaagctgtgtagacatgcaccacacacacctccctccccgtgcccccattccctgtgagtgaacctcatgtgaaaccagattgtataagaaatggacaggagagagtaggcagagtaggggtggcatctgggccagggaggagcatcctacggctttgtgttatgtcgtgtcagtgcatgtttctgacagactgtgcctgtgagatggggcacacaccccatgttgcccctcctctcccttccacattgcccaggctcgcctctcaaacattgtctccatttccaccatgccctgttaacccacataactgtgcagagaagtcagccagctctgttggttcaggcagtgaagcttggctcttggattccagagacccactcgctgtcaccaaaagccagaagaggtccacaacaaacctgtgtccttggaatgtagcgaaacacaacaggctccctagagcagctgtaacaaagtaccaaaaccgaatggcttaaacaatagaaacttatcatctcttatttctggaggctaaaatccaaagtcaagttgttggccgggtcagttccttctaggctgtgagggagaatctgctccaggcctctcttctaactcctggtggcttcctggctatcttggaccttccttgacttacagatgcatcactatgtatctctactttcatcttcacatggggttctacctgtgtgcatgcctacttccgtgtccaaatttctcctattcataaggacaccagtcatattgaatcagggcctaccttatttccaaacaagaccctatttccaaacaaggttacattcacaggtgctgggggttaggacttcaacatcttttggtggggggttggggagggacacaatttaacccataacaaccatcacacttaattttttttttttttttagacagagtctcactctgtcacccaggctggagtgcagtggcgcgatcttggctcactgcaacctctacctctcaggttcaagcgattcttatgcctcagcctcccaagtagctgggattacaggtgtgcaccaccacacccagctcatttttctgtattttttagtagagacgaggtttcgccatgtcagccaggctggtcttgaactcctgacctcaagtgatccactcaccttggcctcccaaagtgttgggattacaggcatgagccactgcacctggcccaaacgtaattttttatattatctttgttaactgctttttttagttataacactagcaagctcatggccaaatatccatacagtatggaatgtacaaaatgaaaaatcaaagttgccttcctcctacctgcagtcctcgaggcagtctttattataggctcactgtggatacttcctgatatattttattgcaaataaatatgtgtatatatggctttgttattgttttacacaaatgggattataataggcatattgtcccattacttgctttttttttcaattactgacacatcatggatacctttatatgtgagtatgttagatgtcttaccttctcttttcatggctacgtcctattccatttcatagctgtagcaaaattcatgtattcagtctcttatggatagatgtttcagtcatttccttttttgctattataaacaatacttatagtgaatattcttttacatataaacttacctaactatgtaaaagtatatagaatagattttaaaggtaaaatcactgggtcaaaaggcatgtgcattttaaaatttgatagatattgccccaaacctcaaacttaataaagacactagaaggtgctgaagagcccctgtggacctgtgaaggagccacagagcttgtgagtattgctgaattaagtgatagatactggttagatagacttactgtcctaactagattagacaggaagggatttgggctggttggtggatatgagtttgtttgtttgtttttgagatgggttctggctgtgttgcccaggttggcctcaaacttctgggctcaagcagtcctcctgccttagcctccccagtagctaggacaatagacatgtgccacccatacccagccgtttatttttcagttcacactttttttggtctttgagtatttaggggaatttctagcaacagcagattaaattcctttttagattttgtctaatagtcttctcagtctatttgatggtcttagacaaattcaaaattttcaaacagacatgggatttagaaagctggagaatatacttccctcaaggagcatcaatgacagactgttttatgctagatcaatgtgaatatttagaatgatcctttctctttaaagtcatttagaaaaaatgacttgttctgttttttaaaagtaatatatactcattataataaaatttcagataatacagaaacataaagaagaaaagacttttctatacacacattttttatttgccaatatgggactatgtattcctgattcttttcccttttgtagaaccttatttaagtatactattttggtcgtaatatttccatgagaaccaaagcttatggagctgcagtgagggcttgatatgtttctctgtaccccaaactgtattaggtggttggactacgtagcattcaccctgtgtcttcaccacatgtgaatcggtctgctcctgccacacactagactctaagcctcttgagggcagattgatacacacacagttatagctcaagggtaagtgccactacagggagagggccaagtataggatgccacgaaagcacacaggaaggacagctaacctagtcctagaagctcaaggaagacttcagagcaaaagtgataaaaggatgttagtcatttgaagggaaagaggggtcatgtagaaggacctgaaggtaagagaaagcacgaggagtctgggcagctgtcacacttcagtctggttggcagacaatggggcctttggtgtgggaggggcagattgtagcaggagaggaactaaggatgccaagtcacgctgtattttaagccaaggtatggactttagactttatcctgagggcagtgggctaccacttaagggttttaatgggggatcctcgaaaatactcctattggaaatgtctcttgaacttctcaaaaattcttaaatcttactttatttgcatttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactc

SEQ ID NO: 36502 - DNA, 89209 bp, Homo sapiens
cggcggccgcgggcaccagagtgccgagcccaggacgcccccggcccaggcccttgggtgagtgcgccccgccagggctgcggccctggaaaggggaaggggacagaggtgtccagactcccgtcggctcgcagcgaagaccccgcgcgggcgggcggggacggagggtgggggcgaacgcgtgggggacccgggtctccaggggcgaggggtgggcgcagctgggctcgcgcagcccggtcttgacagcagctggagaagtggggggaggcctggactgagccggctgaacccccagcctgttggacttggtccaggccgcggccagggggctttggtcccacccccctgggtgggtggggagtccagttttccgcccacctcgaggtgggggcgcctggggtttagaggagggactgtgggaagtgggcgcgtttcctccatccctggggaggggcccaagccctagcgccccccagagggtggcgctcctgtcctcagaggagggaagtgggggcctcagatcaaggaccctgagcggggagggcggtgatgtccttgcatccccagagacaggacgcattcccctgtccctgacccccgcggcagagcggggcacacgcgtcacgaagttgggcgccccctcgtcgcctcccctggctcggcaggatctgaggactcggtgggaattcacggggcggtttccgtgccctgcagggtttggtgccagctgcggggcgcctgggcttggggaagaaaccttgtgtacgcacacctgcacacacacacagtctccggaggtgagcggccccctccctaccataacagaccccagcctgtgcatgccctcggagtccttgttggggtcatagcacaggcccggtggtggggtcaggaagaacatccactgttctcagggctcattggcctctgtccccgggctccattcccctccctgccaagtcagaggtcaggcccctggggcggcaggcaggaaggacactgagggaaggggcactgaggcaggaggggcactgagggaagctggccaggtggaagtaggagagaaaggcaatgggggtgagatggtaccacttcctccccatatgaggctctcaggaggctcctggccccccctgcacaggtagtggtccctccttcctgagggtgtttgggggaaaacgctatggttggggcactggggaaggttgcctcgcagatgaaacagaacattggccaaaggtgtccctgaatgggcttctggactggcacagggccctgagggctgtggctgagtggggaggcagtgatcaggtccagctggccatgggggccccccattcccttctccatgacctcagcctcactctgagagcccccagcagctggaaggtctggtaaggggtgcgtgttccttgatggccttgggaagggttccagggtaatgattaatcctcaggtggcacgagcaatttcccccttcacagcaatatttcagggcaggcgctgaagcctccattgcacaggtgaggaaactgaggctcggagaggctaaatgaactgcctgaggtcacctagtcaccttcagcaaggtctagaatcgtggtactctgactcttgatgggagaagatctccacagcggtggagaggaggaagggtgaacgccgtggtggagtggtccatgtggacctgctcccctttgctgccaggaggtgagggtgcctgtggctggaagctgggtcaggttgaggagagggtccagagtcctaggcttgccttgccaccccttcccatggagggagggttgtcccgtggagcaccataatggtgctttcaccctgggaccttcccagcttgcttgggcaaagccctctcctcttctcttcttcccaaggtgcctgcctggcaggggtctcaggaggcccctctcctggctctaactaccttccacccttaggagacaagaaggattcttcctttggcctcttggagggcagcagggagagaggtctctgccacttaggcctcaggctcccacagcagggcctccacctccctctcacctggccctgcccctgccctgctgtcaaattctggggccaagaggccctttgaggactcctcgggcagatctgtcctccatgctgccatctgtctacggaggcctttgtcctggctgtcagaggctgctgagcagccgcatgtgctgtgcaaacaaccgagacctgagcacggccagacacaaacgcaaatacagttagactgacagataccctgagacccagacacaggaacacacgggcacacccaggccaagacccctgcccccgactctgcctgacacacaagcactgagagtcacaccatccagatgctggcacgtgtgtacacacagagagacggaggttgtcagcaaggagaagagccttttcagaagccctcgtcttctgtcgtctgcctccattatctcctccagggtgcacacatggtacacgcgcatgcaggaagaacacgaggatgccctacgcccttaaaaatgaacctggcagacacgcacatgcacccacccacacccaggccatcatgggtgcacacacgcatgaattacatcagcttcctgcgtgtgggatgttaatgcttcatcacccggggaggggagtggaggcccccgaccgtccccagcaaagcctccccttcctccctcttttctgattcatgtggacccagcttgactggccccaagaatcctgggaaactgcctggtgcttcccactcagtggaccctcctctcctgcctcccctctgtgtacatacccagcgggttgccacgggagcctctccccaggctgctcctttgctgtctctgaaggtgttgttctgcaggtccttcccaagacaggacaggacccagtgcaggctccaagcggctctggggttccctttcctttccacttttgctagaggcattaccaggccccagtttctgctttgtcctcccagcaaggctgggggccagctggtgtgaagggaagggagccctcagcactctctgctcacctccttgcatgccaggacctctgccaggctggccctggcaccctgtgcctctgagagactggcgctgtggagaggtgcttctgtgggcttaggtgaggcctccagggcagacatgctagatggggaggggctcccagctccaccatgctccctcggcactcacaccaagcctgccagagtgctgattccctgtccaagcctggccctgcctcttgctggctgtgtggcccggacaagtcattttccctctctgggcccagctccagctctgggaggcagctcagcctggctgggggatgaggaaagtcagaggtgtgaggtggcagccctgtgccaataaggaaaggaagttgggctctggtggcagtgtgggcccatggggccccaggctgatgacttcctgcagagtgcagcctctggatccacactagggccaagcaggggtcgccagtctcagggcttcttggggcggccaccctggggtcagcccaggaggagggtacccaagggcagtgggctgcagctatgttgctcacatttgtggacattttatgcctcaaaatgtgctctatatttagggctaaagaccagcactgtcaggcaggtggtgactcagagaggaagaagggaaaagaggcagaggagtgctggtggggagacaccccaaaacagaaaggtcccactgggattccagcctttcctactgcaagaaaggaagcaaaacatgatactcctgctttgcaccagcacaatgggagcagcctcgtgtgcctactcactaagcatttaatgagcatgtagtggatcccagggactgtgacaggcactggggcacagagatgagctgggtcctgtggtccctgccacagcccggtgctttgtgtcagatgaggaggtgaggctcaaagagagaaagtgacttgcccactctacaggttaatacctctgccaaccgaggccaccctccctcggacccccattcggaggaagcagacccaagttcgaattctgacattgccactgagcagccgtacaacttttggtgagttcctctctccctctgagtctgtttcttgatctaggaagtgggaatcatagcacttgcctgatgagtatgtttcaagggataagaaggtgaatgcaagcaaacactgagggcagtgcccagcttatcctaggcattctgctgggtctaaaaggacatagattgggagtcctcagaatgccaaatccagtctctgctgtgtgactttggaaaaatcacctgccttctctgtgcctcatttctttctccctagaacggggatgacgagcttttatttgcctgcctccctggggatgttgtttgcgaggccagacatactggctgggaactgctttgaaaaatataaagctgcactcagagaaacacagagagacacactgaaggaaaagcaaacacaaatctggagaaaaatcttttctaaaaacatccaatacttctctacagccagaaaaaaaaaataataagccttttcttcagtgttttgagagtagtgagaattttttccgtaacttcgcatttccaaagtagttggcatggctatcaccaggtgagctgggtaagtttcctccttgaggagtccttgcctggcacatattaggtgttcagtaagtgataatgttagtagtagaattaccagttgcacagcaagaggagaagtggaggcgctcctggaggcgagaccagctacggcgtgggcaagggctgggggtggcaatgtggacactgggttggattcatggaaggtgggggtagggacaaatcggggtcagtctattaagggccttgaatggcaggccgaggagtctgcatttccccaaaatcaatgcaggatacacgggaggggcaggctgagcccactagcctggaatgaggaaccacctggcgtagttctctgccctgccactgctgtgtaaggatggccccctcgcctgtttccctgggcctcattttctcccagtgtgcaaaggagaggattccagcctcttccatcccaggggcaggcaagaggatcaaggcaccaagccacccgggaactaggttgctatgagagctggagagccgggggctgtcattggttcaggaagtcaggaaccttgtgttccgcttctggccccaccccactagctgggtgagctcaggcaagccgcccggcctctttgagcctccctttccatctgtggaatgggaggatgtagtttctgtctttgcagtacagctcccatgagttgaagctggtgactgtgttgtgtgagcctcaagtgtgttgttgtatctctgggggaattgcagtatttcttgaaactacagtacctgttcctcagactcccctgagacggtggatctgctggcaaggctggggtttgggggcagtgggtgaggatcagatgcctgagccacctcagaggctgtgaccttctcaaggccacgggagccatgtgtctgccgcagccaggctgtgggggcagcagagggaaggtggaggtggggcagatgggtccagccctctgcttggctcctgaactctgggccccagttctgcgagggaaagccaccccagtaccctgctcagaggacagccctctccaaggcctcactccttgattcagggctcgaggggtagggtggaggtggctgatggagggtgaccttgggaacttcttcctgcctgcaagctcggtgccagaactgccagggcagccctgattcttcttgctcaaaagttggcagcgtcagggaccctcgagaggctgccaggacaaggcctgagctgatgtcaccatcaccagcctcttgcgtcttcccctgtgttggaggtccagagagaggccatccacccgctggcagactgctgtaggcactgtgcccacccgggcagcaggctcaggatgccatgggactgaagactctagccttgcctcattcaccacttgcctttcacttgaggtgtgggagctctgccagggatagagggttgcccttacagcccctctcccagggctccctgcctctagaaacaggactgggcagagccgctgggacaaagacctcacctgtccgagtccccaaagcccacagccctccctggctggagaggtgtgggctctgtagtcctccgaagggcagagaagcctgggtcctgcacaaactctacaatgctgggcccacccaatggcagtcagggtgggaagtgggcagctagctcaggaattctaggaagattctggatggggggaggcatgatggggcctgagcaattggatgcaggtgggggcattcattgagcacttgcagtgtgctgggccctatgtaagcacttttcatggatctatctcatttaatcctcttagcaaccctcaagggctcagagaggttaaatagcctgccccaggtcacccagctggtgagtggctggggctgagatttgaattgagggttgtgtgactctacttttagccatttctgtgtactgcatgcagaatgagaaggggttggggagggcgccatacagaatctgtgctctgggtaatgggagcaattctgggcaggggcaggagcaggggtggggctgagacttggaggctcacacctgcaggacgtggccctgaagcttccaggccctaaagcttccagctccccctccccatggcctatccctggggcccagtgccccaggctggcttgggggaaaaggatgaatggggacaacttttcaggggttcctgtggacacacagtcccacagaccctgacttctcctggccccctacgtctgtgtaaattcccagcttggaaacccaagaaatccccagcttcagagctgggaaggagcccacagagatcagctggtccaaccccctcgttttacagatagtaattatcatgattatgcctgatgggagcaattcacaaaggactttcacatctgggttgctgctgagtgtgccggagcccttggggccagcaagattcatccacattttgtgggtgaggaaactgaggttcatagaggcaaggagatggacctaggggcacacagttgaccttggtacaggtctcttccttctgagacccagcacctgtgtgacgtggctctggggctgcaccctgcattggagtggggctggtcctgagaggtctgtatggggccagggcaagtatcagatgaggttctgagattcccagtgatgcctgcctcctccctgtcacgggaacaccacgcccttcagtggcgtggtctggaagagacagactggtgggcagagctgtttccaagagacttctctgcccaccatgcacatgggggctatgctgccccagaaaatcagattgagaagggcccttggaggggcctcattattcagagaagaaaactggggagctgcccacagtcacattgtgagccattggtggcactaggcttagaacacagatttcctggctcagctcacagctgtccttgcacgtgtccagtaatagtactaaagacagtctccatttattgtgtgcctactatgtgccaggggtgagcagtttacactgaatcctaagaacaatcctatgcggtaagtacttttattatcattgccatcctcttttacagatgaagaagctgaggctttgagaggttatgaaaatggaccaaagtcacaagccaggaagtggcagagcaggaatttaagcacaggtccatgtgattccaaacccatactgatgccaggccttatgtatattatgataggactaaagttgactttctgtttctttatgttcatagtcaacgtaggccatcattcattcattgaacatttatggagtgctcactaaaacaaggagactatagagctgatcagggttgagggtcagagattaggtcatgaggcagggagtctcagacactgctaagctctctgcctccaccaagaatggctgcgtctccctcctttttttttttttttggagacagagtcttgctctgttgcccagactggagtgcagtggtgcgatctcagctcagtgcaacctcggcctcctggattcaagcgattcttgtgcctcagcctgctgagtagccaggactacaggcatgcaccactacgcccagctaatttttgtatttttactagagatggggttttgccatattggccaggctgttctcgaactcctgacctcaggcgatccacctgcctcagtctctcaaagtgctgggattattacaagcatgagccaccgcgccccagccatctccctcctcctcctgtccccagctcagcccaactacatttgcagcctcttcctctgcttctcctgcccacctgatttacccctggggtaaatgaaggcatgactcagctagggctcctgggctttgtgtatcccaaagaagaccctactggcaacagtgttaacagccaccaccgtgcaagccgttcgtgagcacaaggcaccatgctaaggtgtctgtgtgcatcaccttgtttaacacgccatcactctgtgagctaagagctagtatcatctccattttccagattggaaactaaggctgacggtcacagctcaagactgagtcggggctgggtgcagtggctcttgcctgtaatcctggcactttgggaggctgaggcgggaggaccacttgaggttgggagttgaagaccagcctggccaaaatggtgaaaccccatctctactaaaaatacaaaaatcagccgggcatggtggcgggtgcctgtagtcccggctactcaggaggctgaagcgagagaatcgcttgaaccctggaggcagaggttgcagtgagccaagatcgtgccattgcactccagcctgggtgacagagcgagactgtctcaataaatatatatagctgagttggaacccactctgtccagccctcttgagcctgtgcccttcctcactggctcacactgccctgctctgtatccaggctgtgtagttatgcatttagagccctggttcctggaaggcagggcttcagccaagcaacgggttattaagcacctactgtgtgtcttggggaggtgctttgtgaggctaaagcttgtgaggatggggagattgggttcctctgtgagagatcttgaggctccatgcccgcatcctatcccagaaggcattcaagcccgaggataccaggacagagcagccagggcagggcagtgtgtactgttggaaggactttttccctggcaggagcgtccctcacagtgactcagagcagtgtgaagacctcagagaggttttgtagccatatctgcatccactgatccttaggcaagccactcagcctctgggaccttggcttcctgatctgtgaaatggggaagatgattgtacctaatttacagggtgggtttaaggactggatgaaagcacttggcacagggcctcgggaactagaaggggctgtgccactgagctgcagcgcacgggtgatagggactgaggtcccgaagagctcggaagagctggatctgctctgtttgcacacctcaatttcccccgtcagccatggcagacatgtaactcttgcaggatcagcctcacggggctgttgtcaggatcacagagatcccggaacgcgtaggtgcggccccgtgatctgcgcaccgagagaacgggtcccgcgggagggggcggcgagagcacagtgggcgggcgcaggtgcgcccttgtgagctgggagacgtgcggcggcgcctggcgccggggagagggcgaggacgggcgctggggccgcctccatgtaagggaggggtgaggaagtgcggggggtggcgagcgcgcggccggtgactgggggcgctgtcccggcggctccgggtccccacccttctctgagatgctcccggggcgctgtccctggtcctggagcccgggcggccgtcgcctgcagttcttatgacggccaattggtggcgcccgagaccgcggcggactcccggacccattagagaacacgttttaaaaagcgttcttcggccgggcactgtggttcacgcctgttatcccaacactttgggaggctaaggcgggcgcatcacctgaggtcgggagttcgaggccagcctgaccaacatggaaaaaccccgactctactaaaaatacaaaaattagctgggcctgatggtgcatgcctgtaatcccagctactgaggtggaggttgcggtgagccgagatcgcgccattgcactccagcctgggcgacaagggcaaaactccgtctcaaaaaaaaaaaaaaagcgttcttcattttcctgtcatgatattcctaggaaataagcctgcctacacacctgacttcaaaaaccaactatatactggcataagagatgaaaaaggccctccacctccctacatgaatgctgtggcatgaccacaccacaagagccaaagaagtaaccagccttgggcacctatttattaaaaatatacccttagatttaaaaaaattaaaattatcgtaatagagatggagtcttgctttgttaccaggccggtctcgaacttctgggcttaagcagtcctctcacctcagcctctcaaggtgctgggattacaggtgtgaaccaccttgcccagcctacccttagattttttgtttttgtttttgttttttgagacagagtctcaaaaactccaggctagagtgtagtgctgtgatcttagctcactgcaacctccgcctcctgggttcatgcaattctcctgtctcagcctcctgagtagctgagactacaggcgcatgccaccacacctggctaatttttgtatttttagtagagacaaggtttcaccatattggtcaggctggtctcgaactcctggcctcaggtgatctacccgcctcagcctcccaaagtgctgggattacagatgtgagccactgagcccggcctacccttagatttaagagcagaaagtcatgtcgctgtacctgacctctagttcagaatgacttcagtagctgcacctttgaaaaatgtattatggattaaagccacaccaaaaaatattcatttgtaaaccagagttaggttctaggatgggttacccgggctttttacccacttgaatatctaggaggatatctgatgaacaacaaatctcctgaagtgggactctcaccagcgtagctttcctgtcccccacccactgaatgacagtggcgaccccgtcatttctgaggactgaaaccaccctggcgccctctggggggcagagccacccttgttgagagccactgcctcaatgagggccttgtcggggtggagaggggctctcagagtcccagactggttggcctcctgggagggtggtatcataaggaactgttgggaaactctctccccccattatagatgaaccagcagaggccagaagtgggaaggcacttgtgatgagaaatggtgggttgccagcagagctggggccacaggcaggtctccccaggtcaggactccgccagcccagcttcctgaggggagctctgggcctcaagcagtctcccagctttgtccaactgccccgaaaatgggctgggagggccacgcccatagcagtggaggtaggagatgggggctggccggctagacaccagcctgtaatacatgagaggtgtcttggcctccactctgcaatcctggagatgcagcaattgcactcttctctgacccccaaagagccattctgtctcctacctttatttcttcccagtagttagctggatgctccatgcgtgtttgtgaggtgtgtacacatctgtctgtgtatattgtatgaacataaataatgtgatttgagtaaggatgtgtgggcctgagattcctgtgcctgtatgtgctgtcatcagtgtgtatttacatgcatgtactaacgcagccggagtcagtaggtgcatgtgcactgatgggggacctaagggtgggagctggagttgacctttgcatgtgcacgtacttgtgggtttgcagcatgggggctgatgttcatgtgagcctgtctgcatgcatttgatcttgatgtgatctctacaggcatgagttagatgactctttgcatgtgcgtggcacggtactaggccaagtgcatgtgtgacctgggaaagtttgtgtgcagttgtgcacacaggtctaccagagaccttgtctgtcttgttcagactctatcgccagtgtctgaatagtgtcagccacacagtgggtgctcaatacagtgtcagccacacagtgggtgctcaatactgaatgaatgggggaaggaatgaaagaccgtacacctgggtgctgcctccagaagggctttgcttccagggcctttcaagccacatgatctgcatggagatgagaaacacatcctcaggggtagggcctgagtgggggcaggtattctggccaggccagattttcctggtccctgatggggtccctttaagtaggcaggggtttcagaaacccattgaatagagcaggagtctcagagccagggcagaggctggctcagtaacctcactggccagctgcctagggaagggctgtgagccaagtcacacccactcttccctcccttcccaggggctggggaacccccaggagactctttttccagaagcttcctgggattgggttggtgtggcttggctagaaaggccacaggcaaagtaaggataatgatactttcagagctagcagaattctctcaaggcaaatgtatctttccgttgttaggtctttttttttttttttttttttttttttttttttttttagatggagtcttgctatgtcacccaggctgcagtgcagtggtgtgatctttggtcactgcaacttctgcctcctgggttcaagcgattctcctgcctcagcctcctgagtagctgggtgccaccacgcccagctaatttttgtatttttaatagagacggggtttcaccatgttgatcaggctgatctcgaactcctgacctcatgattcacctgcctcagcctcccaaaatgctgggatcacaggcgtgagccaccgcgcccagcccactgttaggtctttaacccagcaaagtgagaataggggtttaacatatgagcaaactgaggcccagcgaggaaaactgattaatgcaaagccacacaagaggctgcctgggccagggcaggaagcccagacgcctcctctcctgcccaagaggcctggggcagatatcctgaatgagtatgactcggggaggggaggaggctattggaggccctggcaagtgttggctccaccagccccacctagagcccagacctgagatcttcccagggtttgctcctccctctccccttccatctccctggaaagggggagctggaggtaggtaggtggaacacccagagttcaacaagaggtgaacttggaaaggcagctctgcaaccctccacccggtgctcttctctcttcctctacagtctggcagctgtttgaacaacttgggtacaaatctaggaggcccaaaggggaggcttcctctcagagggagggcctggaccctggaaagcagcctggcactgttttctaggtaagaggctggaggccaaggaagaagggggctcaaactccttcaacgatggcagtgacttcccagtgccagtcagcaagcaccccgtgctgactgcggagcagtgatgtccctgtcacagtgggccagtgaggccagtgtcatgggatgttactaatgtgtttgacatcacacagctaggaagcatcagagcctggtccagccctggtccctgtcacactgcctctgtgtgtgtgtgtcagtcctggaggctgttccacatgcccacacacagatcttccccagtctgtcccatagctgcatggcaccgcatagcatacatggaccataatttatcaaatttcctctgggtggccatttagttttagaattcttactaataaatctttgctagccctacaaaaatggcaacttcatatagtttagcctaataaaaatgatgctgctacaacaattttttttcttttcttcttttttttttttttcagacagagtcttgctttgtcacccagggtggaatgcagtggcctgatgttggctcactgcaacctccacctcctgggttcaagcaattctcctgtctcagcctcccaagtagctgggactacaggtgccaaccaccatgcccggctgatttttgtgttttagtagagatggggcttcaccatgttggccaggctggtcttgaactcctgacttcaagtgatctacccgacttggcctcccagagtgctgggattacaggtgtgagccaccgtgcctagcctttctttttcttttttcttttctttttaagacagggtcttgctctgtcacccaggctggagtgcagtggtgcagtcagggctcactgcagcctcaacctcccaggcttgagcaatcctcccacctcagcctctcaaatcactgggactacatatgtgcaccatcacacctggctaatttttagagtttttgtagagacaggtctcactatgttgcctaagctgttctccaactcctactctcaagtgatcctccctattcggcctcccaaagtgctgggattacagatgtgagccaccgtgctcagtcagcaaatgttttacttaacaaacacatgttaagtgacaaatactctactcttctcagtgctttatcattagtaacttatgtaatccttggcaaaaccctttgaagtagatacggttattttcatcataaatcccatcttgcagatgaaaaaactgaggctcagaaagcttaagtaacttgaccaaggtcgcacaggtgacaagcgggagagctgagattttagccttcaacggtgaggatataagcacatgcctcaatgtccattgtccttgccattcatctacaggctcacatgctatgatgcagaagataaattcttggaagtggtcttgcaggttaacaggatgcatttaaattcagccgtcaccaaaggaccaggagctggtcagggactgtcctgctgcaaccctggccaagggaacgtgaccccccactaaccacccccactcccacccccacccccatcccttgccaatgaggcagctgcagctggtcagagcagagaggctggagcccacactgggctctttgtcttcggtgggaacccttcagcccccatggcccctctcaagggcccactgtcccagtaccagtggggcctcccgggggccaggcctggctgggaaacttgccacgttggcggccccttggctactctgccaactgggcatgcagaaaccactcaggaatcattcccactgaaaagactggcgaggtataggtccatgtcgaaggggatgcagcagcccagatgtggctggagtccaggccccagcccaagcactgtgcacatcctcatagcccaggcctagctcttcagtcctctgccccaaccgcctcccacctctctgagaggccctgctgctgctgctgctactacttaggaaggagggagggaggaagggagggaggaaggttgttgctgctactacttaggaaggagggagggagggagggaggaaggaaggaaggaaggaaggaaggaaggaaggaaggaaggaaggaagttcctcccttctcaggcaaacttcagtgctctcaggacccacccctcaggagcctgccctggtgtgattcctccccccaggactctacagcactgcccagagcagaaggggcccagtccaggctccagagcaccttgcaaggggaagccacaccctcctctgaggactgaaaaccaagggacatagttctaggaatgaggaaataatgtttgccctgtccaggctctgaaccctgcaaggggctcttgagggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctaggtgagacaaaccgtagaccctggtacccagactcgtcatttcccaggggatgctggagctcaccaagcccaggcccgggtcccaggtggaacagctccggaaaggcgtctgcagaatccctgctgccctgtccttgtgcccttggtcatccttcctccctcatccccggctgcatctgtgccctgcagtttgtttaaacagaaaatcccatagcaaaccttgagactgtgggggcctccttgggtgcagggcctgggggaaggatctctccctctatggggggaagactgggtgttgggctggagggcagtgtgctctggggtcagggctagtaacccggtgtctgctgacacagctccacttgggtgggggaaacagcttactctgaggaagagcgctggactgtgagctctgggcgagctgggtgcagaagagcgacttggagtgtttagtgagcgaatgagtacctgctgcagaactcagagcccagttccctctaaaggttgggacctggactgcatgacttttcaagaggggagtggaggggggcgtctccactcctcccctttgctcttcctcctcaccagggcaaaggggaaggggactcctgggagaaggggagacaggtgggcaaggaggggctattggaggctctgttcattcactcattcgttcgcgggaagggtagaacgctgtccccctgcggaactcttgtacccggcatttattaagcatctgctgtacgccagggcctgggccgagcgctttacgtgcgtgaactcatttcgtcatccccaggtcctaggaggccggcgggaggaatcccactttacagatgagaaagtcgagggacagggaggggcgggacatgcccgccgtgcagacccaggcttctgggagggagctcccagctcgtgatgatggggacggatccgccgaggagcgcggcggctcgagggggcgggaggagggcgtccctccaacagagggtctgcggcctggacggggggcggcggccgggaagggggtgggggaggggctgccccgggccccgggccccgcaatccccgcccggctgggcccggctcggaaagtcccgcgaagcccccgcccggccggcccagggcggcgcgaacaagcggccctttctgcgccggcggcccccggcagctggaccgcggcccgctggggcgcggacgtatccgagctggggcgggggcgggggcggggcggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtataggtatgtgggagtaggggcaggcaggtcagggggaggttctgctggacctcccactttgcctctgcagctgttgggcccctcagtgacgctctggataaagggactctagaagcccttagcaggtcctgcccaccctgggcaccaggctgccctccttcctgcatcctggctctcaggaacctcctcctccctgggccactggctgcctgggcttggaggcctggaggaggtcagagtggcagcaggttcatcttggggtcaaggggtgcagaggtgggatggggatttatgcctgttgcggagatttggcaaattggagggacgatgggttagacagagtgggctcagagcccctgcccagccagacaagcggctccatgaccttcaccaggccctacctcccagtggtcatagggacccatgggacccaccttggggtgtggagcgctggggcttgtgtgtgggcatggtcagtgttctctgagctatggggattgtgtccaagctgccttccccttgtggacgctcaacttctgaggtgaccccagcagagggtggggtggggtgggaggccagaggctacccttccatatggggtcttgctagctgtcaggtgatgagaggagcctgggctaggccctgagcttcctggccagccaacacgggcagctcacaggctgggtcctgttctatgaccttgggcaagtcctggcttctctgacctcactgtctgcagagtcggccttccccatcagctgtccctgggagcccccagccctgccctgcggaggacgtcctcttgctggcagagttgggctgggctccctcctcatccccttcttacctctgggcaggaggcgagttgtttgttgtcccaacagctgctcagcccctgcccccagcggcaccaaggtgccctcagagggcagtaggagaatctgggcggggcgggagtgctacccacacatgcgtcctggggctggatctgggtggatttgggggagacaaagtctggggtacccctgaagtcttagggagcagggtacgtgtgttggggtgagggtggggggaagctcctcctagatctcctcccagattcgcagacatttgcttcctgggtggatatgagtgaacagcttcaggattgaggcaggctacgggccttgggggtgatgttctttctgcccaccataaaccatagatatccagcaaacttccatcctgcctagaaaggctctaagctagccccagccgcacccctacatccttgccatgatccaagctgctgtagtcactgtcctactccacctgtccccccacccctgctaacaccccacagccctgccccctgccccactgcccccagtcctgcctcttttcctggctctttaacccctatgccttcccatgtccctaatctgacagtcaggcgactgcagcctaagggtgatagtgactgcatcaggcatccttagaaacaggaccttctccagcccctctgggagggtggtgcagtgcaggtgggtgtgatatgctgggccaagctggtgagaagggatgtcccctcacctatggcccctcttgttgtgtttcagggtggacaagtccttcacttctcgccggagtgtgtggtgagtactggggactctcaggagggcctgggtttccttggctggtccctgcagatacccccaatccattcctacccctgcgatgccaggccagaccttaccaagcttccaaccatcctctcagggcaagggggtgggcagaccctcttactgtccccagagtacttttttagagagccttggaggcaggcaaagcaggtttacatcttcactctgccactgcctgtgtgaacttcagcaattccttaatgtctctgaacctcaattttctcatctgtgaaatggggattaaaatgcctattcatagggtgtaaggtaaaaagaacaaaaccaaaaactggccctggcatattttaggccctttttgcttaaatgcttccttccttttttttcttctctatttcttcccacctcagggtggcccctcgctgggctggggctcccttagcctttactgacccccaaatcctctagttactccccccgacagccctcagaaccccttcctcccatatttcctgtgtctggggctgccctctctttggaggaggagggaacgaggcaactgtatgtgcagcttctcaacaccaagaggcaatgggtggaggtgcagcctcacctcgggatacatcgtggcaccctgatgccccagcaggcaggtgcctccgggcttccctggcatcagcatcacgtgggcctggctggctgctcctgctgctgcttcacctccagcaggagagccccccgacggctctggctgctgcttcctgcccctgctcagggctgtctggggtccgtgggtcctgcagtaccccccagctgctgggcgactcccatctggcaccatcgtccccgcagagccctcctgggaagccaggcctggggtgggaggcacacagggtgcctcagctaagctcccagcctgcctttctatttccctttgatgctctccatgcaacctcaggctgcttcctctccctttctgggcatcatctcctgctgctgtgcctagtccatttgagcccctccttctgcaagatggtgtgctatgctcagagcaggggtagactgaggggggataaaagcagaggtgaggaagatgccatcctttccttcagggagttcagtaataacaccactgacaactgccacttgttgggcacctgctatgcactgggtactgtagtagacgcctgacgtgttatctcatgtaactctggccacacctcagagttagggactattatctctaattacagatgagaacaatgaagcccggagtggggaaatgagttgcccaaggtcacacaagcagttgggatttgaaccttgatcttccagactctgtgcagagcccaaaacctcgcctactctgtcccagggccaccaggccacagggagggtctgaacgaaggatgcgcttgagggaagactcagagacaggggccacccagaaggcccaccccagggagccctaagccaagagttagagacgagggcccaggactgattgtaactggccagctgtgtgactttgggcgagtcccatcccctctctgggcttcagttgacccgtctatcaagtaaagatcggccattccccaggacacgccccattacccaaaatgccttgcccgtgctcgcctagctggagccgctgtccaaggtgctaaccctaggccctcccttcccagctgccaaaggccatcgcttaactccagcccatgcgtcagtggtggccattttgaccattaatcatgatctcctggcattcaagggctgtctccacctccttttctagtttggggcttgcttctcccgtgctctgtgtttctgatcaacgggaacatggcccagtcagcatcacctccccttgatgtccctccacttccatttccacaggccctcgccacacctccagcccaactttgtcaccatttgttgggtgttttctttcttgatccccacacccccattccctctttagaatgcctcctctgctgctacagagcatgcattcgtgaatgttcctggggtaggggaaagagcatggcaggtgtggacttgagtctgacaggtgtggacttgaatctgcctctgccacattctagttgtgtgactttggcaagtcattttccctctctgggctgcacttgctgctcaacatgtgcttgttgaatagggcatttccgggagctgacttcaggtgagctgcatgtgttcacataaccctgcagtgcaaagcaggctctgaactccttgaaaggagaggtgcttggtcgctttttgtttttttggagacagggtctcactctgtcgcccaggctgtagtgtagttgtgcagtctcggctcactgcaaccttcacctcctgggttcaagtgaatctcttgcctcagcctcctgagtagttgggaccacaggtgcatgccatcactcctgggtaattatttttgtatttttagtagagacaaggtctcaccatgttggccagtcaggtctcgaactcctgagctcaagtgatcctcccatctcggcctcccattgagtcacatttgagctcaacttagcccccactttctcccataaaggccaggctgtacttttctcatgtctctgtcctccacatggtcttgtgcaactaccatgcccataaatgcttaatgcttgtggaattgaattgagtgtgttcagggaggggaataagtaaaaccttgtcagtaggctgggaaggcttcctagaggaggtgattttcccccacccctttacaaaacaggattaagaggttaggacttggattaaaggagcagtgagtcctggtagaggccagatgtgatcatggctgagttcccctacacatccctaacccctctcagcaggttgtctgcagtggaggacctcagagtaggtgtgcagatgcaagaggaaggaggcccagtgtgagggttgggagccagtgggacagtgggtgactgattatgcagccctaagggacccagatatcctagaatgggggctggacatttaaagtgtattcaaatggatggtgggaggtagagaggtgtcagggtagaggaatggtcaagtggacttgtgcaaggtaggagcgttctgaaaatacctctgggaagaggagagtcaactttggccttaaaactaggagcctgggaggtggaggcagaacccagaaaggattaagagctgacagcatgccaggcattttactctgaaggtctcattaaatcatggcatcagtcctgcaatttggcctgttgttgccagtttagaggccaaaaccaggactgagagtggtggaggctctggctcaaagtcacagctggtgaaggctggatttgaatccagctcttctgctgaggaagggacctaggtcagagacagtgaagctgcagaaatggggaaggtcttggttatgagttaagggaggagcggggagtgatgtagccctgaatgccacccaaacgggagtcactgctcagtccatgtgtcctgctgggaaggcccatctgggtgctgagatgtttcctcttgacagaattggtaccagtctctcccatatatggagcacttcctgtatcccaggccctgggcccagcacttcccctgaatcatttcattccatcctgacaccagccttacagatgactgtttgtcccttactactgtccatccccattttacagatgagggaactgacgctcagagaggggaagtggtggcccaggggcatgcagtcagtgaggggtgaaccaagactgacagtaatgccactctgagcccatgcctttagccctcgatctcctggatgctgcttgtgctgagtggtgggctggggtgggtggccctgtcctcaggtggctccttatggcagtcactgagccagaggccctggggcctgtgtgctgctgcaggaagcacaaggctggcctcattagtggctctgaaatgccaagcaggcacagcccgctgggcctcctcatctattatgcatctggtgggcaggcccccgacgggcagctggcagtgtatgggatgggggagctagcagctgcttcctgagcccatggccgccactatacctctgggcagggatctcccaaggcaaatgccaaggcctcctgcctcatccccttggccaagccagggtgagggggttctactggggacaggggcatggatgctagtccccagctcattagcctggctatcctagcagccacttctctttattttattttatttttatttttatttttattttttgagacagggtctcactctgtcacccatgctggagtgcagtggggcaatctcagctcactacagcctcgacctcctgggctcaagcgatcctcctccctcagcctcccaaagtgctaggattacaagcgtgagccaccatgcccagcccctggcagccacttctaagagaggctgagacttcgattgagctgggggtcatttgggaccagaatgggcagaggtgggctgaaatagaatcttagatgcccaagctcctggctgtacagagcctcagagcgatagagctgtggtcatttgttcatcatttattcatccagccacagtaaccactgaacacgtactgtaggccaggcatggttttagttactgcagattcagcagaaaatgagacaggcctagccgctatactcagagagcttggtttgggcagtacttcacctcactgagcctggatttcctcaactgtaaaattgggaatggcggaggcagactataagtaaatagacaaggaaacaacctctgatgggtacactgaatttctttctttctttcttttctcttttttttttttttttttttgagacagggtctcactctgttacccaggctggggtgcagtggcgcgatctcggttcactgcaacctccacctccgtggttcaagcaattctctgcctcagcctcctgagtagctgggattacaggcgcctgccaccacacccggctaatttttttgtgtatttttagtagagatggggtttcaccatcttggccaggctggtttcgagctcctgaccttgtgatcctcctgccttggcctcccaaagtgctgggattatagacgtgagccaccgcgcccggccaggtccactgaatttcaaagcaaggttacatgctaacaagagctggtccttgccgagagctgagcgcgtgccaggctgtgtttcagagcactttgcccacgttcatgggtttgatcttcacaacagccctgtgaggcaagaccgttatgaaccctggtttagggctggggaggctgaggcaaagagaggttaagtaacctgttcaaggtcccttggcaaagctgagattggagcttaagtagccaggctccagtttgcttgtcaccctgcgctgtatggctggaaaatgaaggagtcctggaaagcctttctgaagagggggtgtttgaaccaaaacctgaaggatgagaggagctggccatgggggagctggcagggtgtccagacagagggagcagcaggtgcaaaggctctgaggcagggatgagcctagtgccagagagacgccctgcttccaggaaggatcctctatagcttcaggagacaagagaaaaatcccctccacatgcgttgtggctctgggactgccactgtttggctgtgtgatcttgagaaatgggtccccatctcacttgtgcacaactctgctatcccacgtctatcctcagcatcatgaagagaggactcttgccgccctgaggtccctggtctggttggccctgtgtgcccctatctcctggtgatgctcaaactctggtctatttgtctgagatgcatgggaatatttgagttctgttaggtagacctgagttcaaatacccagttcaacttccacttacttgctgtgtggccttaccccaactactctgcctctctgaaccccagattgtccataacaatggaaacagtattgcttcgaatgaaatgagtgcagagtgtatgcgcagggggatgttctcccttctaactaagcatttgcattttgagaggaaagactcattcatccaaagagagattctctagtgatagaattttaggcactgtcgtggccacagggggtgagtagatggctaaggaggggattttctttttttcttttttctttttttttttttttttttgagacggagtcttgctgtctcgcccaggctggagtgcagtggcacgatcttggctcactgcaacctccacctgccaggttcaagcattctcctgcctcagcctcctgagtagctgggattacaggcgtgtgccaccatgcccagctaatttttgtatttttagtagagatggggtttcaccatgttggtcaggctggtctcgaactcctgacctcatgatccgcccgtctcggcctcccaaggtgctaggattacaggcgtgagccaccacacccagcctcggaggggattttctgatagcccagatcctggaaaggccttctgagttcaggatcttccccaaaattcattcattcagcaaactaattcaataagcatttagtgtggggacaccctcctagggccaaaccctgtgctgggcgttggggacttggtggagaaaatagatgaggccacttcttctgggttcagagtctagagagggtcataaggaaagaggtggtttgatgggaatgacatgtgctgactagggagatgtgagggttgctgagatctcagagaagggactcctgcccacatctgggaatcaaggagggcttcctggaggaggtgactcaaaagttgaagtgggccaagtggcagtgtgtgtgtgtgtgtgtgtgtgtgtgtgtgtgtgtgtgtagtggggaagggaggtgcactgtgcgagaatgttccagggacaggaggtggcaggtcagcaatgtggaggagaaaagtgtgtggtggcacatgctggattcaagactgagttgggcctgacaggtgaagggaagagagacagccaccagatcatgtccctgtaggccctgctgggacttctgtgggctacgctggaaggctctgaaccccccagccaccatgggaagaggcctgctagggtgccagtcgcccatcctcctccctgctccaaggagctgctgtgtgagactgagtcagccgcagctcagggaggccctgactgtgctcttagtgcagggctgtggaagccctggagccagagtctgggctgggaccgcagatgctgtctcggccaccagctggctgggtgacttctctggatctcagtttcctcacctgtaacatgagggcaataaaagtactacctggaagattggtggggggattaaatgagataatgggtgccaaggcctgaaaccagggcctggcacagagcacgtactccgtcgatgccagctattgcggttactgccatcatcgcggtcatggttacctgctgcgcctgcagtgggtgcggaattgcgcttggtgtgtagactctgtcctctggaagcttgctgcctgccagggggtgacctgactgcctacacgtgactgtacaccccagccgtgggcactggccttaggcactggccctgagaacactggctttggagtctgatgggcctggtgccaggtcctggccagtgaccttgaggagtccgtcaccttgctgagccttggctcattcctttgtgcagtgggggtgttcatggcccctgcctcacggtgagtgagaggcagtgaggaggtgcttttaaagggccggccggtgtaacaatgcagctgtttctgaccccatgctgcaggagggaagaaacacatgcctcggacccaagtgacctagagaaacatcaccctccctctcagaggctcattttcatacctatgaaatgggaaggttggctgtgatacactctgatgtgctggggttctagtggagttagcttgtccctaagtttgacctggtccagctgtttgctgtgtgacattgggctagagacttaacctctctgaacctcagtttccatgcctgcaaacgggcaatgttcacctcctgggatctttcagggcttccattagccactcgttaattcaacaaatacttacggagttcctaccacatgccaggtactagtctaagaactggggatgcagcagtgaacctgacagacacggtccttgcttcacgcatgttatcctccagtgcaggagacagacagctaaggtagcttcagatgggtaatgtgtagtacggatggggtgggtgcaaggcctggctttgccaagggtatcagggaggggcctctctgaggcctgaatgggaaggagctggctgtgggaagagtagtccaggcagagggtagagaaaatgtaaaggattgggggcaggaataggactccttcccccgccccaaagctggaacattccagatcatctcctggcaacaggtggaggtggctgagaaggcagagaggctggaagcccacttctttcagatcaggaactgctccccagtcaggtgtggtggctcatgcctgtaatcctagcactctggggaggccgaggtgggtggatcaccagaggtcaggagtttgagaccagcctggccaacatggtgaaaccctatctttactaaaaatacaaaaaaaaaaaaaaaaattagctgggcgtagtggtgcatgcctgtgatcccagctactcaggagactgaggcaggagaatcgcttgaacccaggaggtggagattaccatgagccgagatcacaccaccgcactccagcctggccaacagagcaaggctccatcccacacacacacaaaaaataactgctgcccacaagacaggcccggtggggtggtggggagtgtgggcagccatggaagaccaggcttggcttgagtctcaagtgagctgggctgtgcaggcaggaggctgggctccaacctgtaggagcaggcaggggtggagctcactgcagggcagagtcaggcctccagcctggagcccacctgactggatctacctggcgcaaagaccctggacctattttagtcgggggtaagggaactgctgcttgttctcccctcaccccagccagcctaggcactggccccaggttgccttggcctttcccagcccagctgcctgcaggctgaggaaaggttctttgagatgacccattacatgtacacacacacatatttccctactcacactcatagacttgacccttgtagagacagcttcatcatgaacatagaggcacagacatacacattcattcatgcagcagatcagacccaaacagacccaggcatgacctgaagaaaccccatttctagcaggagagactgacagtggcttaatggtcacaccatgaaatgtgcaaacgcaacaggtaaatccatgaaggcccaagacaggcttctgggaaagctggtcaggttcggagcagcttctcctggtctggggagggggctctggaagactgaatacagacatagcacctgaaatgtgatccaagcggacgggaagggggtaacaggcagggggcacagcgtgtgcagtggcctggaggtgggaaggagcacctcgggtttgaggagcggaaaggagtctggagaaggaggaaagaagccctggatgaggccagagacagtgggcgggtgggaggggggccggggatggggagcagacacgcagggcctcgtgggccacgtgaggcgggcgtctggatcctgcttgcggcgggaagccattggggccttctaggcaggtgggtggtgtgatcagatccaaacatgcgacacaagcgctttccctcccacacccattcacgctcctgccggggcctcccatctccattctcacccacagagtcacacacaccctctcgcaccaccaggcagagctgcggaacacccggtgccgactcccaggaaaagtgtcagacgctgccccgcccaccggctgagtctgtgcggcagggccctggggtccagccagggtggatccttgctcactccacatccgcacagatgtgcctgtgccccccgcctgcccccacaggagtgaggtcataactcttctctacacgtgcaaggtggcttctagcttaggacgtactttcacgtgcattctctcatttaatgctctcagcagccctgcagggagaaattctcaacaccattttatagccgaggaaacagaggctgagagaggtgaagggactctccctaggccacacagctagagcttggcacaggcaggatttgaactcagttccgtttgactttcaggtcttgttctctggcccatccagactcagacacactcaggtgtgactgtcacctttccaggctgtcactgagaaggtgacaagtgaccttcaatgccaaatccatccacaaacaggttgatcaacacagaaagttatttagagctccagggaagggcctgggctgggacgtgcccacctgcctggtgaccctgaggcttctgggggtagtgccaggggtggggctgggcacctgccagcctggggcagctcagggcatggagcccgcgctaggagcagagcctacatttgcatttacaaatgaagtagacagccctgtccccacacatgctaacccggctggcctggcttgcaggacgtgacagctgaagtcacagggcacatccctgggcccagctgcctgggccacttctgtgctgcctctgctcttccctgaccctcggagcaggttgtctaatgcctaatgtaggggaaagagtgtgggcttgggagccagccagaatgggggtgcaacccagctctgtgacgcctggctcagggacattggtcatggtgtttagtctcttttcgtgtcagcttctcccccttggaataaggggtgagtcatacctccctctcaaggtgatggaaaagggtaaagcagtcaggtgctcagggagctgagtcatagtgagtgctcagctctctaaaatctttaatttttttctgattacacaaatactaagtgttcattataaacatccaaaccgtgcagaaaagtatttgccacagaaagcagaagttcctagtggtcctgcttctcagagataagccatgtaaactttctttttgtttttgtttttgtttaaagagaaagaggacggacagacagacacagcccaactgggcttcatcccactcaaaattctgagggcttttgggcctcagggtcccatacgcagcaagccccttttctctctctcttttttttttttttttgagacagagtcttgctctgtcgcccaggctggagtgcagtggtgcaatcttggttcactgcaacctctgcctcctgggttcaagcgattctcctgcctcagcctcttgagtagctgggattacaagcatgcgctaccatgtccggctgattttgtatttttaatagagatggggtttcaccatgttggtcaggctggtctgaaactcctgacctcaagtgatccacctgacttggcctcccaaagtgctgagattataggtgtgagccaccatgcccggcctttttttcttttcttttttttttttttaataggatcttgctctgttactcaggctgaagtacagtggtgcaatgttggcccactgaagcctcaacctctcaggctcaatcagtcttcccacctcagcctcctgagtagctgggactacaggcatgcaccaccatacccggctaatttttgtggttttttttttttttttttttggtagagatggggttttgctatgttgcccaggatggtcttgaactcctggctccaagagatccgcctgccttggcctcccaaagtgctaggattacaggcgtgaaccaccactcccggccagccatgtaaactttgacatgtaattttaaatttttacaaatgagatttttgttgtgtgcagcccgctttattcacttaacaatatgcctcaaacccccttttccatcaagactaaagaccttctttgtcattgctgtatagtattccatggtttgatatatttaactaatctccttgtaatggacattgaagtggcgtccagatgtttgcggttgcaaaccctgcttcatgacttttttgttcatatatctttatgcattggtgttatatttctggagaataaatgcctagaaatggggttgctggaccaaagaatatgcacattttaacatccattgcctctgccctcagttacagggatcctagagtcatcaagaggcaaagaattccagatgtggggctggatgcagtggctcactcctgtaatcccagcactttgggaggctgaggcaggtggatcacttggatccaggagttcagaccagcttgggcaacatggtgaaaccctgtctctacaaaaaaaaaaaattagccggatgtggtggcatgcacctgtggtcccagctacttgggaggctgaggtgggaggcttgctggagcccaggaggcagaagttggaatgagctgagatctcaccactgcactccaccctgggcgacaaagtgagaccctgcccccaaccaccaccaaaaaaaaaaaaaaaaaagaaaaaaaagaatttcaaatgtgggaggcaccttgaggtcctccagtcaaaccccccaccgctcctcccgttcccacaccttcagatctccctggctgcacctctgagaagctcactctgcctttgcttgatgcagagctcggtaccttacatggcaggttgctcaggttgctttcccttcctccctccctccctcccttcctccctccctccctccctccctccctcccttccttccttccctccttccttccttctttccttccttccttttccctcctcctcctcctcctccttcttcttcttcttcctttctctctctttctttctttctatttgagatggaattttgctcttgttgcccaggctggagtgcaatggcatgatctcggctcactgcaacctccatctcccgggttcaagtgattctcctgcctcagcctcccgggtagctgggattacaggcgtgcgctaccacacccggctaatttttgtatttttagtagagatggggtttctccacgttggtcaggctggtctcaaactcccgacctcaggtgatccgcctgcctcagcctcccagagtgctgggattataggcatgagccaccatgccctgcctaggttgctttactcttgggcagctgtgtttgtcccatcgtttctaccttctcacaacttccacctaggagtcttgtctcagtcctcaggcacctacagaggaaggaagaaaggaaggaagagaagggaaggccaagaaatgctcatggtgaatgttaagcactttacaccaatgaactcatttaaccctcagaggtcagcactgctatccccattttatagatgaggaagctgaggttcatagtggttaagtaacttgtccaaggtcacacagctgttatgtggcagagttaggattcgcactcaaggatctggctccagagcccacactgacgctacactgcctctctaggcaggagcctgtaatttattgagcacctactgtgtcctcagctctaggctagtcaggttgtccatataatacctaatttattccacacaacaaccctgcaaagttggtgttactctcccattttgtagctgaggaaactgaggctcagagaagagaagcgacttagaagagtctaaggtcctctccactgggaaagccctccttcagggttctgcttccaaccaatccttggtgaactcagtttccagtttctcatcctcccattcgtcctctgtaggatgagagagccggcctgagacccaatttttagtagagaaactgaggcttggagaggttatggtgacttaatcctgcacacactgtgatctgggggcagagctagggcttccccatgtcacctttggttaggagatggtgaccttgtctatccccgtgggggtttcgccttggcctgggtggtcaccccgcctggggagttgtgaggggcagggacttctgctcaccagactggcctggagcctatgaggcagcaaccccagccccagctagggctggtgcagagcgggaggaaaggattaagcaaggcctcagtgctgggggactcactgtctaggcagtgaagccagaggctcctcaggaacagtccaggcaggtatctttggggctctgctttgggactggggaggcctggttcaccccactctgatcccagcacccagcaccattgtccactccagagcagacctcaggacatgtgttctgaatgaatgactgagcagaggaatgaagggcagatgggggagtgggtagatgaccgagtgggtgagtgagcgaaggaatgcctggagctcagagaagggagaccccctgggctgcggaggctggggagggacaatgaggtcaatgtagggagtgaggagagacagaaagcataggcggctgtaataccatgtatgggctgacgggtgctgggaaggtcaccctggcccagacttgcccatcagtgggagctgtgtcctgcgtggacgtgggcagggggcagagcagctggggctgagcttcggggtggaagcttggaagtcaccatctccatccaggctccagttttcttccaggcagaatggagattagcattactgctctgtgttcctcaggaggctgttgagagggttgatggcaaaggcagtttgtaaactggaaagtgccaggctagggaagcagatgatgttgttgcccggcaggaagaggccctgcggccgggtcatctcagagtcactcctcctccttaccccagtgcaggggaggagtcagtccacactgaagtcctcggtggggtgggaagggtcaggttttggccacagtggggctcaggccacctgagcaagggagacagatgctggatagacagcaggtaaatgggtggcctggttcccagatgctgtgccctgggcagggaccggtcccgtgaccacctctctaggctgccaacctgttatttgttcaggaggcctctgcctggcccagctccgggatccgggtgtctcggcatgcagccagcatggggcgagggtggcggccccatgtgccaccttcctgcccatccctctgcccagcttggggcctgagtctcccacccacacccccagggggaccctgccagctctgtcacttggtagctgttgaggcccttggcccatcataaacctcactaagcctctgcctccttatctctgaaatgggtgaagatagcatcctgaggtcagggttgttgtcataaggattgaatgacatcacagtgcccgcatggcaaatagtccccctgccgctcctctaccccatcgccacgctccctctagagtcctaggagaggtcaacggtgcccagggaaaggggacacaggagcctcccgtgcctgtgcctgtctgcttaggctcccagtgggctggggaagagggggccagcctctccagacctagctttggaaacctgctcaactggctgccccggccaccttccctggcactttggcagggacaggggcaagccaaggggagggcagtgccggctggttgagctcagaaaacaatgggcttctgtggcccccccccccccccgggagggggcagttctggggcagccacttggttctggtttcaggagattcgagtcccctcagacccgatgcccagggctaggagacccggctctggcagccccccagccctcatccaaaggagcctctctcagggttgccctccacagccctcttctcactgggaggtctgtgcccttgtcctcatcctccaccccacatgggtggtagaacttggtagaaccaggttgatctcctggaaaccaggaagaccccagggaactggacccaggccttcccctcctgacttctgatgaccagtgctggactggccggaacccctcaggcccctgttccaggctgctgcccccaaaaaattcttctctgccctgtattcattggctccctgaacccctcccccgcccttccagaccactccctctttccgtgtccggtctcccagcctgtgtgcagtgggtggctgtcctcagggtgggctcctcctgctcttgctccaggcactgtcacctgtccagatccccattcccctgctcccggtcccagccttcttgccttgatggtcctgtaccacctgccctggccaccagagtttcacctggttgagttgaatttcaaagcatcaatggttcactaggcagaaaagcaggagaaggcacccccagcagagggggggtgcctgtgaacagtgtggctggttaggaaagctgcctgcagcctggggaggttaggacagagccaggacaggcggctggggcaggacaggaaaggggaggtatgaggttgaggctggagggagtcagcaggggctggacccactgggagaccaccatccagggcagctatctccggggggccaaagggccaagcccaccacccaggacagccccaccacacttctggtgccctgaaaaggttgggctctccaggagagtggccagtaataataattacaagcactttatagcaactctatgaggtgggtacattatctctcattttgcagatgagagaaaaagacaggaccctctcaccacccctccagctggttaacagttgagaatcaccctaggaaggcatctggccacctgtgcttggtctccccctctgcccaaccattcctgagtctgaccctgatgttttgttggtctgtttccattgtatagatggggtcttgctctgtcgccagggctggaatgcagtggtaccatcatggctcactgtagcctggaacttctggctcaagtgatcctcccacctcagcctcctgagtgcctgagactataggtgtgagccactgcagtgggctgggtttttaatttttttgtaaagatgagggctcactttgctgcccaggctggtctcgaacccctggcttcaagtgttcctcccacctcagcctaccaaagtgctgggattacagacatgaaccactgagcctgggctgaccctgctgttttgcagagtatggaactctcttgagatcttcccaccctggactggtggaaggcctgtgttcttatccctgatctgctgctcacggccttattggctgactttgaggtcgtgttttcacctctccaagcctcagtttgccctgctggcaattggggatcctagtgactgccttatctccattccagttccggtgagagtcccaggagtgagcagataaagaaggcttttgaaaagtacaaagaactgcactcacgatggtgcgattattattgttacctcgatgcagagataagggagggggaggaggtgcagtgacagttgccaagaaaccggggagctgtcagcagcggcttccggccgggcccatcccacttaggagctgggcccttcccccacacccttgcttcaccctttccctggaaaagatgggtgctctccccgagagggagagatagctgccacacagacacaggggctgaaggtgaccccggaatgtgcctggcccagactccaggttggctccagctttccatgtgaccttgggcgggtcacctcctctctggctgctcccatttcatgtgtcagaggaggcagcgtgcaggtgtccaggccagacagagcagagccggagctgggcctagggaaggcgcttggcggtggctgcaggagccagggccgtgatgggaggtcatggggcaggaggccaggtgacgggactgagggcctgggctgaggacagtgggatgcacgctgtggaagggacactggactggagtcacatctcagccctgccctttcccattgtgcgacctggggcttgtcactgaacctctctgagcctcagttttctcatctggaaaaaaggtttatatctcatctggatttcttttttgttttttgtttttgtttttgttttttgagacagagttttgctcttgttgcccaggctggagtgcaatggcgcaatctcggctcactgcaacctccgcctcctgggttcaagcgattctcctgcctcagcctcccaagtagctaggattacaggcgcgtggcactactctcagctaatttttgtatttttagcagagatggggtttcgccatgtaggccaggttggtcacgaactcctggcctcaggcgatccacccgcctcagcctcccaaagtgctgggattacaggtgtgagccaccgtgcccagcctcatctggatttttaataagttgctgtggctctggaatgagacaatgccagtgtaagctccagggtgctgcacagatgtgaccacggtcatggcagggggaaggaggagaggggagagcgccccatgtcccggcatgctctgggctccccgcagctgctgccgcccaggaggaatgcaaagcattttaagctgagccaggccagggggttggatggtttttggagacgtggggaagggatagagaccagggggacatccatgatgtgaactgaatggagaagaccaggaggagaccagggtgggataggagagagaaggggagggacagagaggttcgggttcgtgaagtgggaggaaacgaccacattgtgggtggtctgcagaggccagaggaagaaggggattggaggggtgctgggaaaggtggggcagagatgggcgagctggtgaggaaggctgagcaggaaaggacgtgaagcagagaagggcagagggctggtgaggagggaagaggctttcattcattgcttcaaaagtatttattggggccaggtgcagtggcttatgcctgtaatcctagtgctttgggaggccaaggtgggaggcttatttgaggccaggagttccagaccagcctgggcaacacagcaagacacccatctcaacaacaacaacaaaaaatttatttttaattagccgagcacacacctgtagtcccagctactaggaggccgagggggaaggatcacttgagcccagcagttcaaggctgcagtgagccatgatcatgccactgcactccagcttgggtgacagagcaagaccccatttcttaacaacaacaaaaggtcaggggcagtggttcattcctgtgatcgcagcactttgggaggctgaggtgggaggatctcttgagcccggaagttccagaccagcctgggtaacatagggagacctcatctctactaaaattagctgggcatggtggtgcctgtagtcccagcaacttgggaggctgaggagggaggatggcttgagcctaggagtttaaggctgcagtgagctttgatcacgccactgcacaccagcctgggcagcaagagcaagatcctgtctcaaaaaacaaaaaaaaaaaagggaaaaagaaaaaagtatttattgagcaactactatttactaagtgtcagtggtatagtgttaagggcactgcaaccagatgttgggggaggtcaaatcttcagactttcatttactgtgtgtgaccttggacaagttacttaacctctctgtgtcttagttccctcctttgaaaaatgcaaattaaatgagttaatacaataaagtagagcagagcctgcacatagtaagctctgtatcagctgtgtcggccgttgctgttgttactattacctttccgacttgacttgaggtgctggatcgtgttcctgagctggaagtcgtaaggctctgtggggaggtccacaggattggacgtacatgttataaagttcagatcttgggctctgaagtcaacaaacctgtgtccaaatgcctggcctgcctcattgcctgtgtgagcttgggcaagttaacgcacctttctgagcttcgtgtggaaagcaggaggtttctgaacatctgcctctttggggaactgtgaggattaaattagattatgcaagacgcccggcaggacgtggctttgtcattcctgtccctcttctaccccttcaggtctggggatggatggacaggcagtgcccagagcctccagtttccttctctgtccccatcctggagcccctcccttcccctgccccttacggcctcagcagtggctttttaggtggagttgccttcgggggacaggactgtggccagccaggaactggagagccaagggccctgggatggggtcccaggtgcaagccagagcaccctggccttcagaggccgctctggttctgcacccacatgagcaatcctgagtgaaatggacacctacacatggggagactgaggcagagagggttctggaagggggtttgtcagggactgctgcatggctatcatatgagcctaggggaagacagaagggcaccgctggactagcctgatcacaagcaacagccgccactgggcagccacggccgcacccagcactccagctttaccgggcttctaccccaggacttcctgacccccaggcagcctctgccctccaccccactgcaggatccctacttcctctagggcatgtactttaaattccagctccatcccccattcgctaggggaagtggcttcacctctctgagcttcagcttctccatctgtgaaaatggagagaaataacaccaaccttcctgcacagtagttgggggagagtatatgcttgacgcagtcccagtcacatagtaggtctcactaaagagtccccatgggagcctcagtggaattgcctggaagccaccctccctcccttcctcccttcccccctcctttttttttttctgaggtggagtctccctctggagcccaggctggagtgcagtggtgtgatctcagctcactgcaaactctgcctcccaggttcaagcaattctcctgcctcagcctcccaagtagctggggttataggtgcccaccactgtgcccagctaatttttgtattttttttatttgagatggagtctcactctgtcgccaggctggagtgcagtggcgcaatttcagctcactgcaacctccgcctcccgggttcaagcgattctcctgcctcagcctcccaagtagctgggactataggcgtgcaccaccatgcccagttaatttttgcatttttagtagagacggggtttcaccatgttggccaggatgttctcgggatctcttgacctcatgatctgcccacctcggcctcccaaagtgctgggattacaggtgtgagccaccacgcccagcctgtatttttttttttttttttttttttttttttttttagtagagatggggtttcaccatattggccatggttggccaggctggtcttgaactgctgacctcaggtgatctgcccgccttggcctcccaaagtgctgggattacaggtgtgagccatcacgcccagcctgccggtaactatttctatggacctctctttagtccccaccctcccactccagactctccccatgtcagtgtaccctgcaatatgcaggaacctgtgcgtagggatgttcctttgctcacaacccttcagtgactcccaaccttcattcattcattcagtcattcaacaaatagtgaaacttggggagccagagtttaccatgaacaaatgatgtgaaagttttcattgagtgaattcccatgagctgcccaggctctgcgatgaatgtttttggaaactgaggctgagagaggctgtgtcactaacccaagctcacctagccagtcagtgtctgagactatctcccccacactgatgccacaggcttgaaatgccactgccaccatatctgtccttttgggtcaagcattgcccagcgcagacccctcttgtaagatgccatcactcctgggaggtggagaggcctccagtgcataagtggggctgtggatggttcctccgggccatttctcctgctggagtagctgggctgagtggaattagaagggaggctcagactgggcgcagtggctcacacctataatctcagcactttgggaggctgaggcgggcagatcacctgaggtcgggagttcgagaccagcctgaccaacatggagaaaccccgtctctactaaaaatacaaaattagccaggcatggtggcgcatgcctgcaatcctagctattcaggaggctgaggcaggagaatcgctcgaactcgggagacagaggttgcagtgagccgagatcaagccatttgcacgccagcctggggaataagagcgaaactctgtcataaaaaaaaaaaaaaaaaaaaaagaagaagggaggctcacagctttctcagtcttcttcctgggccagactttttcgggtccttcccctcttggggtgtggcagccccggctctgcctgactcaagcctgctgtaggccaccagcgatcatctgagtcaccctcgagggaccagcctctcttgatgggacctgagcagaggtgcagccacgtcagggtggccctaggcagcagcggaagccaggcctgcttgcccagccccaggatcccgggaaccactgggcatttcctctccctgccccagaggtggcctcggcaggctttttagggtgataggagctgacttcaccctcgccagacctgctttctttcctcagggaagggtgtggtgtgggcagagagtccgggcttagactcaggcaggtctcatgcagatgctagctttgctgccggccagccgtgtgacctctgtgcacagctgggtcctgtctgtaaagtgggaataccagtgtggtgaggaggccatgccctcgggcctagaacgagggctcagcacagggcctggcatgtggtaggcccaatgagcgtcagttatggtcacggtcactgtcattcgtaatagcggtagccctggtagcccctcaatgccaaggcggctactcccagaggctcagggaggggtccattgtagaggcgggggcaccctgcttagtccagaaagctcaccctccacagcaaccctcagtgcccctgcctcagtctactcatcttcagagtaggtcactgcttggctggaggcctaatggagagcttggggagagaccctgtccacgtctctgatctccggggaaggagaagcctgtgtggtagccctgctaatgaagcccctcctctccctcctcttggggaacccatgaccctctcctccgtgaagtctatcctccctcacatcccccagctctgagagtgactctcccagagttcccaaatttcctggcttggggctctccctgacctcagactctttctcttccaggaggagcgatgggcagaaccagcacttccctcaggcactagacctgtcacgagtgaacttagttccctcctatactccttcactctaccctaaggtaagtgtccccctccatacctacggcccctggtctgccccctacctccgacacatgcccagggctgggaaaggcccaagaatgacttttgggcaaaggtaaaatgttcaggcagatgctgatggggtttagctcctaaggggttgccactcctgagcccggggtgaggctggtgcagtcacaaacgttgaacctaggtctgtagactgtggcagggaggggcttagggcgaatctaagcaaaacagctgggaataaaccagccccccagctatcttcatcatctccacaatcaacgtcaccatcagtctccttatctgtaaaccaggtgcaatgagaggacccacttcacagggtcattgtgaagattgctgcaaagtacagacagggcggcccaggcacagcatccggcacagagcaagagccctgtcaacgagcctctatcattatcgttaaaatcaaacgtttgcccagtacctgcttcatgccaagccttgtgctgggtgccaagcgaccagaaaccaatctgatacagatcctgctctcaaggagccacagtccagtaaagcaatagataactgaacaatgtatgcaggacatcaaatagcagaaataacctctaatatttattgagacttactgtgtactaagagagtacttaatgctttatttgcagtatttcatctcatccttggactatgtgatagctactataatcagtcccattttgcagatgagaaaattgaggctcagagaggttcagtcacttgcccgaagtcactcaggttggatgtggtggggccacgaccggatgcaagctgtctgaccagagggcctggtgttagggcctctctgatgcaggggtgacaagctctcacttttgcagtactttttgcagtttctaaagcacacccacagacatcatgccacctggtccttttagtaaaccttgggtagtaggcattatctagttgaggatgcaggagatcagagaagtaaagtggtcttcccaaggtcacacagccagaaaatagcagaggcaaaatccaccaggctcctccctgagagctctggcctggaataaaggccacgtaccttgcctaggctgggagggcagatggccaaggaatggtgtccatatgtggggccaccaccttcatgggggtgccacgtggggctgctgggagcagcagcaggagattcctgagactgactcctgttttctctgtctgggcaacagcccaagactggggcatgtggatccggggcttggcaggaagggagagactcaatggcagccctcacttgacagctgggttcatgaatgaagctcccagtccctcttcccctgagcatctcaggaggagccctgggttctcaccaagggctgtatgccctcggaccacagcttcccctccctgggcctcagtcttcccatcaggagacgagagagagagagagcagcccatagccctgggccctgcgtgctagacagcctggggttggccttctcggattattgaaaagctgcctcccctcgggcttcctggcttccacccagtctggctagaagcctccgtttgtgccaacacagctcagacagcgggctctgaaccttcccttcccgacagcccacccccacctcagaatcaagagtctgtggaccatcctcctttgacaggagaggaaaccaggggctagagagactgaatgattcatctggggtctccagcaagccagtgctgggctgagggaacacaggcctgtgacatattctccattcccctcccctggtgcccctagctctgtgcacatttataacatggatggcatccatctgaagggcaggtgaccttcctctgccagtgggcaaatccctgcccgtctctgggcctcaggttcctcatctgtaaaacagaggtgacagtttcttctctacctgccttgccagcttgcaattgggtgaaagtactttggaaagtagaaattaggaagctgagctcttatcagcgtcattacattcccagggctggacagggcacccagaagggacattctcctcccttcaggccccacatttgtacaggcatcgagctacccaggaccctccttccctcctccctacaggggtttctccactcggggattcagaaacctgcacacacgtacatacacagcctacccacacctacatatggggacagagtcacagacacaaaacacacagccacagccactggtctgtaaatatattcagagacttgcacatgcatgagatacacatgtacaaacacaaattcccataccaaggcattcccatacacacagaaagacagtatgcccacatacatacagccacatccggtcgtggagtctcacacacacgcacacatggctgcacgcatatgtgcacacaccttccatgccacctggcacacagccatctccagtgctgtgagcaggtctcgcctcccccgggggcagtgtgggaatggatgtttctctggctggatttcgatgggtgcccggaagcattcaggcctggaagtggctgcataaatcaatatttgctgttgttaattattaaaaccaaagctacaccgtgtctggaacacccatctccagagttcctgctggctctccaggcccaaacctgattcaaggccaggtctagggggaaagggagggcacagtgctttccttccaggagcccttagttctggggctggagggtggtgggcagccactggcagctctttcaggaagctgaacagaggtatggctctgagctggtgggcagccctgcccccgcaacatccaaagcagctgtgtctgcttggccacagttcaggaagcatttgctgtgttcccaacatctgtctggaggaagtggtagcaaggccctgtccctgtccctgctgtacagtggctataccaggccagggacacactgcagagccagctggaagggcctacagagtccttatattttaaagatggggaaactgaggtccagagaggaggcagggactcactcaaggccactcagcaagttgtagctagaatccacatgtcccaaaatctacttgggtcctttcctccataccacgggcctggcagcccctccctaggtgctgtggccatctcccccaggatctggggcagctagggcgggggaagggacggagcaggccagccactgtgaggcatgggaagcaggatggaggagaggaggaggaaaagggacagaccccaaagagtagcaccaggcctttctctggattccactttgacttcttcctgactgtgtggtctcgggcaagctatttcacctcttggaaccggcttctcatctgtataatggagatgacatttgtacctcctgggctgtgacgagattacgacacatgcgaagggcccagcattaagtaggtgctcaagaaaagccctctgtctgcaaggtaacccaaccctgtccttgatgccgaggcggggtacccagagcctgggaagatggagaaagtgaggtgggggcgcgctggggagaaccgagtggggggccccctcggggagcccgacgcacccaaagcttctagcgctcgggccggaacgcgcaggcgcggtgtcccggggccgcgggccgggccgcccggggggcgtggcttcagcgcccccgccccgccccgccccgcgccgtgccgcccgtacctggcgccccgccccctccgggccccgccgtggggcgagcccatcgcaggcagcgccgccgccgggagccgggagcgcggagctcagcgctgcggggcccggacccgggcgcgcgcgggccaggagccggctgggccagctgaagtgccgccccggcgggggccgggccgggccgcgctcaggatggcacagctgcggcccgcggtgccacccggccgtccgcggaggggctcgctgcccgcgggggccagctggcaggtgaggacccgggcggggcggcatggcggagggaccccggggctgggtcaccccgactgctggggagcccggccggctctgccccagccagggcgggcggacaaggctccgtcatggtgggcgtgtgagcttctgggctgacactggccacggggcgcacccctaccctggggtcccggaccctggggctcttgctgtggcctcccgggtggcactgtggctctgggctgcagcggcagggtgtgtgtgggtgcgtgctaccgtcgggaccactttaccctgcccctgccccgtttggggggctctgaatgctccagggccactttgtggtggtgctttcatgtggggcaccccccatctggaccccatctctcagagccctcgcgtgtgtcagggcgtctgctgctccctctgaggctgtagctgtgggtgttgcttgttgctgtgtgtacactctgggtgacaggaccatgtgtcagtgtttatgtgactgattcccaatgcaacaaggtgtattagagtgttcctggctacgtttggtcaccctgagtggggtgtcttaatgggggacattaatgcacccatcatcagtgtgactctttggggtcatgcccagctgaggttgtgtggctgacctgggcacagaagccaaagttgctgtcatacagtgtgttgtgttgacaggcatgtttgtctgcctggacttcaggtgtgtgtctgtggtttctgcagtaactgcctgcggaattgtctctttcaaatgcagaggtgttgggtgtgaccataggtgaccatgggtcaaggtgtcctatggactcctgtggtgggttttacaaggtgggccttgcctctatgggcaggcctcacagtgtgcacatttatatgggcttgtgacccttcccagagctctgtgtgtgtgtgcgggtgagggctgtgtgaggtttagaccgtggccctcatccttggggattagctacccctgcagttgctggataccttttgagtctcatttactgttgttatgtgaccctgccggggcaggcagggcttgtagccatgagtggggctgcatctgggtctccctggacacacctgcccgcctctgtggctgcgtgttgtcatgcctcttgttctcacacgagagtggtttgtggtgttaccatagctttgtgtgcagttactggtgtgcagacctgcacaggtgtgggtttgcatttgtgtgtgtatctctcctggtacttggacctgcatgtgtttgagtgggtgtgctcctgtgtaactcagaacgccaatgtgtatatttgtgtgttagtatatagctctaagaatcactgtgcacagtccccatcatatgtgtttgtgtgtgttgttttcttggtacacgaaacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctggaggctctgggggcttcccaggcccagccccgagccgggccagccggcagggatgccgccttccaggaaggctcgcagggagttggcgctggagaggccggggctgccaagcgcagctggcagacaccggattaactctgcgtgtgccctggctcacccgggagagggtagctcgagtgtgcgagggttcaggtggctcatgcaaggtgctgggccgctgggcatcccagtgtcctcttccctgaagcacccccagctcactccccttggagaggggtgggctgtctgagcagtgggctgtggcctgagcctggttgactgagccttgcccccttccgggagaggtggggagaagcatagacccctcctggggatccaggatgggctcatctctgcagctgggacttggggacgatctgtccctccccaagggtagcagcccgtcagggagcaggactgagtgggtgggtggctctggccctgggccctaggctctgggttcacctcacttggcaatcggccagaccctgtggttctcccacacagaaccccctcccacgatgctcccgtcactcccgcttgctactcagacaggtgcctcggtcactgatcagagctggtgggacccggagggccggggcgggtggagactcctctggggcttggcgggatcagctgacctcgctctcccctgtctctgttgcagaacacagatctatttgagatgattgagaagatgcaggtgaggatggctctgtggcctgttctggggagccacagagctggctgggctggggctggggggcccttgctgcatctccagcccttcacctccctgaggacaggccacgccagtagaagatggtggctattggttgtccagggtcctctgtctggaggtcagggtagaggatgcccaaccccatctctgatgccggagtccatctaggctcccagctcccatccctgtgtggaactgcaacagggctggggtcagttcatcaacccaccccacagacatacactgcctctcacccagtgagagacaccgcaggctttgtggtggggggcccaggtggaatggaactggaggaggggacagatgctgggggcctgtcagccagagactgtgctgcaggagtgggaggtattacccctccaccctccaccccacagccccgtctgcgtttcacataggtatgcatgggaggtgggccgggggtgctgggatgggagtgccttgaataccctctgatctttgatgcctcctgtttctctttctgtctctctctccaatgcctcctatttctctgtctttctgtctcgtctctgcctctccctccccctctctccctcaacacatatctgtgtagataacagtccccccacccgccagctcgcacaccggcatgtgcacctcccctgcccccactcccagcggcacgtgcgttcccgcagagtccccagccctccctgaggctgccagcctccagccccggtcactaccgggacagccagcccttcagacaggcccagggcccccagccagctagcaccctgccctgggagtacccctaccttcgcgggccgcctcctagggctttccccttgcacgccttggggaggggaggcagcgcctggcggcaggcctgggagggtgtaacagtgctgccttctcttacagggaagcaggatggatgaacaacgctgctccttcccgccgcccctcaaagtaggtgggcctggcagtctgcctccctctctagggggtggagggggtccgggaagtgctgccaccactgcccatcaagcaggaaatccatcccctttcagcaagtagtcttacagtgtgccaggtgcgggggtagggggggaggcacagcttctagcagggtagacccagcccctgccctctaggagttctgtgatggggagaacccctctcttgctagagggctggggcctctattctagctcctcctctcggtcttcactgctgcagactccccctgcctctccaggcgtccccaccccaaactcaaagccctcctctctcaaagacagctgctgccaaatgttttccctgaaaccagtgatgaccagcagttgcaggaagactccaactcaggccctaggagacttatgagctcctgctccataagctgctgtctggatggggagggagtgatagggaggcaggcctgggtgccccccagccactggtgaggagactgaccggaggcaggggactcagcgagatgagggggaggctcttgtttttgacccacttttcttagcatatggttcttggtgagagatcccagagaccctagaagaccaggcctggtggagtgggcccagggctacagggtgagggttagaggagggtgcatgggcagtaagcctgatgctctctttggggcagaggccctcacaccagcagcgtcggtgccacctgggagcctgtgaggaatgtacattctcagaccccgcccagaccgctgcatccaaagctctagggtggggtgcagcaagccctccaggcagtccagcggtttcttctggggaggcagtgagccctcctttctccaggcaaggagagccccagaagatgccagcactcagcacgctaagcctgcctcagcccctgcccatctgtaagaggtgatgaggccagggccccatccgcactctcagccctgaggctggccaagcagaggccagctctgggggcactggaggatggacagatggagagacccttgccctgtttgtgttttgcagacagaggaggactacattccatacccgagcgtgcacgaggtactcagctagaaccccgcgcccacccttactcaagcccaggaggcacttacacagggcttctggataccaggtcctcctccttaggagcctgacctgcaggccttgctgcgggctggagacttaatttgcaggcccaaggcctcagagcccatttgaacccttaggccttctgagccaaatgttccagcctcctgggccaaggtcatgctccagctctacctgcccccacaccccctgttagagacttgggtctcggcgctgtctgggtctggctgagggaaagggctggagcagaaccctggggcccacacaggctctggcctgtcccctcataccccttagccacgacagaagcggctccaggtctgagttgggagggtgtcctggggcgcccagtggggtacagtgtggggtggctctcagctgagtccctcttcaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggtgggtggccggctggtgcagcggggctggctggggtgggtcacagttcagccccattcgaggtgggcctgggagggagcagaacccatgggccagggctgggtgacagtcctagagccctgagtgaatgtgctcccaccacacacactcccagtccccagggaacatgcatggcagaatcacttgttcattcaacattgattgcaaaggcagcattatggcatggtggttcatggcagagactctaccagggcttgaatcctggctctgccacccactacacaggacatcgggtaaatcgcttaacttctctgtgcctcatttcctaatctgtgaaaatggtggttggtggtaatgatacccacctcctgaggttgctgtgaggctttagtgagctgatatctgtaaggtctttacagtggtgtctgggacaaagtaagtgctcagtcaggggtggcaaataatgagcactagctgtgtgcctggccctgttctaggcaccaggtatacagcagccaacacaatagacccaggccctccctttgggcagcttggagttaggagaacagtaatgtcatgggttgatgcagcccctgccccaccaccagcacagagcagggaccctgcccagcaacaacttgtcagagtgttgtgggagccaaggggaggtcccatgccgggaatgtgtgtgtcaggttgcaggccgggtgctgtctcttcgtcagcatagagccaaaatggggaagtgtgtcgtgggctctggagcctcgtggcatgtgtgggaatcttggctcttccattaactgtttgtgtgaccttgggcaagttatttaactttcctcgtcggtgaaaacagggataataaaagtacacgcaaagcttctagaaccacacctggcacatggtaaatactcagttaatgttagctgttttcatgtcttcataattacttggtgatatcaggattattctgtttttgcagaagaggaaaccgaagctcagataggtaaatgatttagtcaaggtcacacaatgactaagcctgggaattgaaccagctttggctgaccttccattaaggtgcatgggagagatcatgctcctagtcattgtatgtgtgtgtgtgtgtgtgtgtgtgtgtgtgtgtgtgtgtgtgtgtgtgtgtgtgttgggaagagggggtgactccttgggggttcggaagatgtgtgacctcagtctgggcctggccattggcctaactctgggagacaccggtgctaaccaatggagttaggggaggatccactgtgactgggactaaaccagcaagcccaggttcaggagcctttgcctgggaacaaacccagaacccagcatggaattccacttcccagctgagccctagaggtggagcgagacctgcatcctaggcacctgctgtccagaggttcccagctgggtctggcaggtggtaggatctgagggtactgtatatgccaaacacatggttggtactcagaaaagtttgttgaaagagtgacaagtgacagatgaaggtaggaacagatgaaggtagtggacctcgagtgcagcaggctctgaagaagtgcagactggagggtcagaagaggcagctgggcgccctggcttatacctgtaatcccagcactttgggaggccgaggtgggcagatcacttgaggtcagaagttcaagaccagcctgagcaacatggcagaaccccatctctaacaaaaatacaaaaattagccaggtgtggtgctgggcgcctgtaatcccagctactcaggaggctgaggcaggagaatcgcttgaacctgggaggtggagattgcagtgagctgagatggtgccactgtactccagcctgggcgacagagcaagactccatctcaaaaaaaaaagaagaggcttcatgtccaggatcagattagcagtaatgagggagaagccccagggctggcagaatggcagggccccttcctgactccaggtggggtaatgggggaagcagccaggtgctcaggcactgggccctatcctggcagagaggggaggttaggatgactttgggcgttgacttcctgggaccctgagcccgctctcccactgtgtcccgggggctcctctgggcttgggggtgtccaaggaacctccccactctctggacttccctgccaggggcctccttatcaagtgcctgccactccctctctgctggatgatgtcaagcatttgggggtttctgccactctgtgcccaggcagagctgggggactctgccccaggtccattgagaatgcccctgagctgcggattcgtggggcacattcactggtccctgcctctatctgctcctggcctctgagcacaggtgttcatgtttgaacaggatttacttctaggatgattcctggggcgggtgtggccgggcagccagctccactcccagaacttgggctagggctggggctgaggttggcaggaggagcccggggccaggctgggtggtgtctccctgaacttccagccctcggctttgggacttccccacccggaggtgccagccctgggctcctctctgggggtgccatccctgccgcagccacccctgatactccccagggtgtcttcccaaccctgtgccctctcctccaggtgagacaggagggtggaaacctgcctggccagccaccctgtgtgttgtgagatgtttcgcttcctgtttctcatgggccctggcttcaggggccacagagtcacaggttgggcaatcagcttttgctcattgagcacctgctgggtgcccagccctgagaaggaccagggctgaagacaggcatgcaggtccgaatatggtccagactcgatgagcacccagagatccagcgttactacccaccttcactgaactgagccaagcacttcatccctttcagtcctggctgccaccaaagtacagggttccctcctatttggcagactaggaaagtgaggcacagagcggccaagtgacctcctcaggctgcccagctggtcagtggcagagtggggctttgagtgcaggtctgtctgatgtggggtctgctatcagccgtgacacctgctatcggcgaaggacctgcatctgggagtgggttggctttctggccttgtttccaaaagccccatgctcagcctcacccactcccctggcccccacctcccactgcaggagcatttcaattactactcactggacgctgccctcggccaccttgtcttctcactcaagtacgatgtcatcggggaccaagagcacctgcggctgctgctcaggtgagggtggtgggggagtcctgagatggcaggaagggctgaggtcttacaatctcagagcccatctcatttgacccactctcttcatcaaggcccatagaggggcagggatttgcttgaggttgcacagcaagttagtacccgagtcagcctgacacccatcatcacctctggtcctcgctgtggtccacccccttctggccttactttgtggggggtggggttcccattttcctgtcctgctgcccaggccttcatcgtgtgactttctcttctcaggaccaagtgccggacataccatgatgtcatccccatctcctgcctcaccgagttccctaatgttgtccagatggcaaaggtgaggtctccgctccgctgagcttcccgggctggctccgcagatgggcacctgtggggcttcagcttgccttggcgcgtccccttcagctgtaggccctagccctggcctgccgccctatcctgaggctgtctctcacttgttcccatcgtgtcttgggctgccacgtgttctcctaggcccccgtcccctgcctgtgtgcttttggttttctctatagcaccttcagatctcaggggacctccgttccctgagcaacagtgaaccccgagtcctgctttagccttggccattcccagcatggctcctccccagaccttgaccagggaggcccaggcagccccatcctctcctccctggccccacacctcacacccctcccttatctcctcctgcagttggtgtgtgaagacgtcaatgtggatcggttctatcctgtgctctaccccaaggtatggctggatctgggcacagctcactgagggtgggtgagtaactggaagactgagcatttattaagcaccttctgtgtgccagatactttcccaaggttctctcatttaatcctcacaataaccctgtgaagtccacaatttgcagaagaggagccaccgaaagggcctgtgccttcccccagggtgcacagcagataggagggcctgcgtttaagcctcggtttgtctgccttagaggctggcctcacatctggaacctctgtgatgtttggggaccctcctgagagcaagctgtgccatagtcctcccctggaatgggtgtcttttctaccggccttgcctttttatcccagaggagacctatagagagagaatagccctggcacttcctgctcggatgctggtagctgggctctaggcactgtgacagtgtggggataggggcacgggcttctgccttggatgagccaggggcacctcctggaagaggacagacaggtaaacccttgggtccctgactgaattctggagcagtgtgaggtggtgtggtccaggaaaggtatcctgaaggggcttcagaaatcagggcccccctcctgcttatgggagaggaaactgaggcctaaggtgaggaggagaacttgctcaatgcccacagcaaattggtgggacgtgtcctgttctgggaggatgatgtgggtttacagaggagccgaggagtgagttgggagttagagtggagtaggggtgggcttggcatggcaggactggggctcacagcaaaactcaggagcgatgaacttaagctttggaatccaacagacctggggtcaaatcccaagcctgcatgtgcttgcaagccattgaccctaggtgagtcacttaaggtctctgaacctgagtttcagaggggacagctggactgtctccctcccaggcttgttctgagaatcacatgacgtgacgtgtgtagagcgcctggctcagtgcttggcacgggggaagagcacgtcgaatggcagcttgcacacgcagcctcttcacccggcgtcctctcctgcaggcttcccggctcatcgtcacctttgacgagcatgtcatcagcaataacttcaagtttggcgtcatttatcagaagcttgggcaggtgtgctcacctcctccctgccgcccctccccacctggccccatatctggagcctcacaccttttccagggcagcacaccggccaagggactcaggagcccaggggctgccagaggtcctccctccggccctctctgggtccaagtagggacagagggcaggggcttctcaggaactccagctcaatgaccttggcccctcatccccagacctccgaggaagaactcttcagcaccaatgaggaaagtcccgctttcgtggagttccttgaatttcttggccagaaggtcaaactgcaggactttaaggggtgagtattagggtgggctgagcagagtgtaatctgacttgtgctcctgggcagggagggagcccctgtcctggccccatggaggcctggccagggctggagactgaggcgtggcctggggggccccggggcaggttccgaggaggcctggacgtgacccacgggcagacggggaccgaatctgtgtactgcaacttccgcaacaaggagatcatgtttcacgtgtccaccaagctgccatacacggaaggggacgcccagcaggtagcctgggcacccccacctgcctcctgtcttccacctgtcctccccctccacctgtctgttcagcctccatcacgccaggctcagcgctgggccctgggatggagatggaaatgatcagcgcccccacttgtggggtctcgttgggtcaggggagacagaaagccttggtttctacagtcagaatggcacccacttcctaggtgagcataaatgcgtgggtgcatagagggactagaacagtgcctagtacattgcaagagttcagcagatctgagctggtgttttatggggagtggagagcatcatggggtcatgtggggacatgtagtcttggcagaggtgggagtcaggaaaagctttcaagagaaagtgacttttagtccgtgaaggagctgggagaaggaagggaaatgttccaggtggcgagaacagcttctacaaaggcctggactcgaggacatgcaaggcatgtgccaggaactgaactcagaagcgtgtccccttgtcctgagcctcctacagggctatctgccttcccagtcaggtccccagcccagggggataaaaggaaatgtgagaaaaatggaaatagctattccttatttttagtgtcttttgactttcgtttactaagggtctgtgttcattttagcaacatgaatgtataccaagttgagcttgtttattcaattgggggccatgtttggggcattgagataggagaagggctgagaggtagggtctggggaccaagagacctgggctcgagtccccaagctcattatagctcattatagcaccttccaagtcacttctctcggccttgatatcatcatctgccacagcatcccaagaaaactaaaataatttttcttgtaatttcaatagatatccaggtacaagtgggttttggttacatggatgaattgaatagtggtgaggtctgggatattagtgtaccctcatcacctaaagagtgtacgttgttccaaacaggccatttttcaactaaaatagttttaagacaagtttttttgctacattattttggggaaagcaaatccttagatgtgccctctgactaccccaaaccctcctaaacccccgtgggcacccctctcccccatgggccccctctggccagaccacgaaggcccgtggctttgtgctcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtgggcgctcttggagcctcccaggggcatcagcaagggccctggctgcagctctgccctccctgggatgcccctctgagcctcactttttccagctataatggggggaccatggaaggcttcaatggtgcactgttcacaccacgccccctgtcgtccccaaagctcaccccctcagagaggacagtttccctcctctgcctcctggcctggtatcactgtcctccacctcccgtagcctcctctgccttcaccatcccgatgattcctaaggcccctacccatctccaccactaaaattcagggcaaaagatagagggcagaaatctctggaagaaagattcatccagcccacagtcactgggtctccccgaccaaggggcagtccagggaggcacagtaggggtttctggctgggtggggcagagcagaccccaggctccacaggaacagacagctgccctcccttccaggtctctgtcactgcaagagatgatgtgcccttctttggaccccccctcccggaccccgctgtgttcaggaaggtgaggggcacccccccagtcatgggcagagcaggacaaatgggtgggggcctggggggtgcatacacattctgccttatgaggtcccaaagtctcattgtatgccagggcagctgggctcccctaactgcaaccggggcctggcttttccattcatcttgaaaacaccttttttttttttttcacaaggtcacaggataaactacacgattgttttacactttccatagtagactggcctctcctcatttctgttctctttctgacagttccagtctctttctttcttctaaaatgtttggggaggggcacacttcaagcctgggcttcagctctgtacgtagcgtgttctgctaccctagactgaagcagtaggttgagaccccaacccagaccctaacatctgtggagtttgctctcccgaaggcgtgggcagccatgaagggcactggggccccttgaaggtacctggggagctgagcccagggagatacccttttgggagtgaagagggtgaccccaggccccagcagagcatggttcaggagctgcagcctctgcctcgttggggttccgacccttgtttatgtgtcatctcaacttcccttccttatctcctccacactgggagtttccaggggcctgagttccaggaatttttgctgacaaagctgatcaatgctgaatatgcctgctacaaggcagagaagtttgccaaactggaggtgaggatgggctgtgagggctgggtgaccctcttctcaccttccaacctataacttcagccctgtccctgggaagggaaaagccatgttcagaccttggccttagcggggacacctggggctggatggattgatggacgagtaggaggtcggggagaggaagccggagggatactgaggagttcccaggagatgctgggaggcggttaggctgacagggacaccttgggacctgtcaggtgggggggtggacctggggggtggggacatgaagccagatcttgaaggggctttgaggggcccttcatatgagggtccctgggggatgcttgagctgtggagtggcctgggggaaggcggtgcaggagccctccgccctccccactccccactcattcagagaaggtggcccgtgcctcagaaggtggccaggatttgaactgtgggccgaagggctgatccttggggtccctcctgacggcccgggcctggcccacaggagcggacgcgggccgccctcctggagacgctctatgaggaactacacatccacagccagtccatgatgggcttgggcggcgacgaggacaagatggagaatggcagtgggggcggcggcttctttgagtctttcaaggtgaagggccccaggtctaactggccggggagcagggacgtggctagggcggaatcccgggctgaggctgatagactgatggacacggcgtgggggtggagtctggcagaaggggcgtggctgagggggtggagtcccggactgggggattgacacagcatggggagtgcagctagaggccgttcgcattggagtctgagagggggcgtggctggggcgaagtcccggactggggctgattgacatggtgtggaggtgtggctagaggccgctcgcctgcgggtagagtctgggatgggacgtggctgggggtggagtcaggggccggggctaatggacatggcgtgggggtgtggctagaggaggctctagtctgggatgagggcggggctcgaagtggacttgggctttagaatgggcttacacttggggacatagtctgccttgggtagagtttgaaggagcagcatgtaaggtggggccctggcttggggaggagtaactgttggaggtggggcctaggtggggaattcacctgggaattctgctgaagggtggaggattctgggagacagcaagggctgctggtacaaaggctgctaggtcagcaggaagagaagagaggaagaggctctgtcttgactgagggaaagaaatagagttctcagaagaggtgtgtgaaccatgatcattggagagggacttggcctgtgtgacctaccctgcctgtccctggtttagcttagcattaagagcacggacacttcaaatttcagctctgttacttaccagcttgggcattctgtgagcatcagtttctttatctgttgagtagggtaatggcaacttgcctcatacagttattgttatctgtaaaagagttaggttagtgcaatacaagtttaaaagcaaaatgcaaaaccttgcctgtctgcctcagcaaatgttgtctgaaatgagaagtgtggggagtggagtagttcctggacagggtctggactcactcaggccacagggccccaggtggtagcctttttgccaccgtctcctccacccacaggaggataactgcccatcctccagcttcccggccggctggtcacacctcaccctcaacccaggacaggtcacacagctggagctatgggttggaataagggaattagcccggctgcccaggcctgcccaggaactgaggtgaacagatcgtctttgagaaagaggcttggggactggagacaggacaggtggggtcaatatggatctggggtgtctcctttgaggagggctccgatggtcccacatctggtaggtgctggacggtggacctagattaggtcaaagaatttctcagaagcagcggagtccagagttgagggcatgggtcctggcatgccgggctcacccctgcctcagttggcatgaaatgggcatgattgctagtccccatcttgcagggggatccagtgatagagtgattgtaaagcgctggtcccatagcaagcatttggtgtagattggtctgaaaaaaacaaggaaagagggtgggagggaagaaaagaaagaaggcaggagagctctaagaggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacagcgggtcatccggagccgcagccagtccatggatgccatggggctgagcaacaagaagcccaacaccgtgtccaccagccacagcgggagcttcgcgcccaacaaccccgacctggccaaggcggctggaatagtgagtgccctccccctccccaggccccggcccctccctggggggccctcagctctcctctgcctcctgaggcctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatccacccacctacccatctacccatccacccacccacccactcatccatccacccacccatccacccacccatccacccatcaatccatccatccacccacccatccacccatccatccatccatccatccatccatccatccatccatccatctctatccatccctctatctccatccatccatccacccacccaccgatccatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtcttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtggggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagaggtgggtgagtgggggacagtgccccattcccctgcatccccatccctgagccccattcggtggcaaagcaaggcaggcagaagggagtgcccgcccctctgcctctccatccccactagtgacagctgtgtggtcaagtccctgctgcgtgtcgggcaccagggccagcacgtcacctaacgtgccacatgcagatcaagaagcggtaggtcagaggagtcaaggggcttgcccagatcacacagccagtgatgggcagagctaggatctgagccctgatctgtctagggccagcatccgtgctcttcccacggccccagcgcatgtgggagggcctagtgctggttttcagggtggccacagatgggcctggggggtccatgagtgtgggcagcatgagggcagtgagcccaggccagcagcagggctgcccccggacatcagaggctagctcccggctgcctccccgatattaaccatgtgtgaccttgggcgagtcactgacctcctctgagccttactgtcccaacctggaaaagggacaagaacacaacccatggcatggggctgctgtggggactcagggcactgcgtgtgaggccagggccaggtcccctgagagggctccaggacgggagtgggcattgtccttgctgctgccagagctccgcatgctgtgagtcctgggttcaggtcttggcactgccacgtcctagctgtgcgtccctgggcaggttccttatccataatgggacagctatacctgctcctgtggagaggacctgggaggagtcccatcctgtcccatatagccccatcagtgccaaccccatcactggccaggctagccagggagcccacaagactgctccagggctggccctgagtataggggcgtgggtatgaggcaggaggcaccgtgactcccctcaccgcctgggcctcacgctacgcctgatgccaggcctggtgctgaatccccccgctgcccccgtgtgccccgcagggagagccctccggctggtcagaagaccccagacagcgggcacgtctcacaggagcccaagtcggagaactcatccactcagagctccccagagatgcccacgaccaagaacaggttggggctcagggcacgtggggcttgggggcttgggagtggtgaaccgtccttcccctcccctgcctgggcccgggacagcacaggagccttgactgtgccacagcagggtgtcagggggacctgggcattctctggggccctcctttgacatatacccagcgagcactttgtgcacgcccagccccgcgcccggctctggagcacagaggtgccctgcgcataggtccccgcctcacggccgcaggtccatcagaacgcggcctcataggctgttgccggatcatggtgataggaggaacccgaagcagggttggggggatgaagagggactgggggcagaggtgttttagatgggtcctcggggagacacctccatggggtgacatttgaattgggaactgaaccagccctgctaggactggcatggcagaggagctcggccagtgcagaggcctggggcacactccagggacagaaagaagggtggctgggagtggtgacgtatgcctggagtccacctacctgggaggctgaagcaggaggatgattttagcccaggagttggaggctgcagtgagctatgatcatgcctgtgaatagccactgcactctagcctggacatcatagcaagactccattgcttaaaaaaaaaaaaaagagtatctgaggggctgggcctggacagacattgtgacattgtgctgggtggtggcgggaaggaggttggagaggtgggcagacactggcttatagcttagcaggctgtacaagagctttgactttttttttttttttgagacagagtcttgctctgtctcccaggctggagtgcagtggcacaatctcggctcactgcaagctccacctcccgggttcacgccattctcctgcctcagccccccaagtagctgggactacaggtgcccgccaccatgcccatctaatttttgtatttttagtagatacggggtttcaccgtgttagccaggatggtcttgatctcccgatctcgtgatccgcccgcctcagcctcccaaagtgctgggattacaggcgtgagccactgcgcccagcctaagagctttgacttttatcctaagtgtgacagggaaccttgggaggattttaattacgagggcgatgctttaagaagctgacttcggttgctgtacaaagaggctggagtggggtgggatggaagcagagaggccagtgaggaaactgtccctgcatttggtgtccgttggctgagctgcctctgtgttgggctctgtgggaatcaagaggactcagcccaggctaaagagccgggtaggtgaacagagaggcaggaaagggtggcagggaccagggagacgcagtatgcaggagccagagtggggagggtcattctcaccttgggaggaggaatcagggaaggactcctggagcgagagccctaggctgattttttaaaggcacatttgcttttcgggatttgagaggactgagactccaggcaggaggcatagaggccctgagcatgaaaaccttgtgggattaagagagtagactgtggagttgcctggacctcaacccctgccctcccacctgtgctgagtgaccctgggctgtgtgcctgtcccctctgtgcctggtgtcatctcatctggaagatgggtataataatcatagcgataagataattcaggtaaaggcacgtagagcagtgcccggtgcagagtgaacgtgcacccgatgatgttagtgtcgctaaccgctgctgtttttgaacaccacgccaaggatattgtgctttacctggggaaatgggaggccaggagagggttttgagcaggggagggacgtggtcagatttatggattaggaaggacaatgcgggtaggaggaggctgcagggggagtctggggggctcagaggcccaaggatctgtaaggggtcctcaaaggtgcttggctgctaccagctgggcctcccgggttggggagggcaagggagtgagggcctggcccaggaggggctcggggtggacaccggctaatggggcactgtctgtggcagagcggagaccgcagcgcagagagcagaggcgctcaaggacttctcccgctcctcgtccagtgccagcagcttcgccagcgtggtggaggagacggagggtgtggacggagaggacacaggcctggtgagaggctcaggggggtcaggggccccacaggagcttggaagggggctctttggtccctggagatgccctgagtagaaccacgagcctgggcgtggctgagatgtgatcaggggacccggcccaaaggagcagtgcagacgaaccctcccctgctcagaagccttccacggctccccagcactgtccacaggaagctcagtctctggagctcttggagatctggtcactcccttcctctctagtctcctctcttaccacttcagacattctgtactccgttgcagtcccccaagcctcccaggctcactgcacccctggccctttgcgcatgtgccatctcttctgtctggaacactcttcctgccgcctcctcctttctttgccaggctggctctgactcatcctttttgactgagtctcacacacctcctcctgaaagccttccctgatttcctaatctcggggtaggttaggaagcccctttacgttctcacagtcctcgggctttgcccggaacaccctttatcattcttcattctgcaaaccatcagtgggcccctgttccttgccaagcgctgccccagatacaacagatacagctgggaacagtgcagacccaggccctgcctgctggggcacagagtctagaattgcaatggtctcttcacagcctgccttgcctcccagatatcaggctcctgagggcagggcccatgcctgatttatgtcagtggcaagccctggagaacatcagtgaatgtttgttgagtgagtgagtggcagtgggtggcgtgtgcctgggtctgtgcctgccctgactctgccctcctgtggtctccctggggcagacatggctaggcccgtcctcctcgcagagggtacgggtggggggttgtggaatgcagtgagggagaggggctgggagggagccctagccagtgccaagggcataggctaacctccctccctctttccaccccctccccaggagagcgtgtcatcctcaggaacaccccacaagcgggactccttcatctatagcacgtggctggaggacagtgtcagcaccactagtgggggcagctccccaggtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccagtgaggtggctccctcctgcccccctccccaggcccctctcgatcaccccacccagacgccggcaagttgggggaccctgcgtgtcccgagatcaagatccagctggaagcatctgagcagcacatgccccagctggtacgtgcagcctcctggggctggtgctgagggagccccacccgggaggggatgagctggcggggaggctgggagctgaggctcgaccaagaggtccccctaggccccgctaggccaggaggggtggggcttgcccggcctggacacagccagtgactttgtgcacctgtgtctcccgccccgttgcttctcccgtcttgccacctgcctcaccaccactgtctgtctgcagggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggtgggcccctcccagggtggggttctctgaggcagggacttggcagagttggggcacactggtgccagccacccaccatgccatgtttcatggtgtctccatccccctttgccctgcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtacccagagttgggcctggctttgtgtgaaccgtggccagattgaccccagacagatgtccagggatgtcaaggtggcagggagcaagcctgtccccatcagagctgctgggcctggggacacctccaaagccaagccaccagctctgtgagcaccgcccgtggtttcctccccggggtgctgtccttccctgcatcctgggccccttccccactgcaggaagaacatggctgtgctgtcaggcagacctaggtttgagtcctgggaccgtctcttgttagctgggtgggtggcgttgagaaacttactagcttccgtgagcctcagtgtttccttttgtaaaataggagtggtagtgtttctcccaagggtttgttgtgaggattcaatgagctggtgcgtatcaaacatacagcacagtgtctggcacacattaggtgctcaattaattacttccttctccctgttctcatattcagtgaatcccctgatatggccacaaggcggcgccaagggaccacttacgggacccgatggggacccaggagacggggatgagtccaagtccctctaccaggatctcacagctgggacagtaggacgaagggtgatgaggggcagccggggacaggagaggtgtgcacaagcagggcctggggagagaggcgtcagggaaagttcctggagttgctccccgttcctgagaaggcctagggaggagggacgctgcaggagggggcctcgagtaaagggcggggaggcagagcacccctggaaccaggaaggtggcagccagctctgaatggtgggaaggtgacaatggaggggacagggagatgggcagggatgaggccagaggcaatgtggccttgaactcccgacggagaggccagggctctgcgccaagggcagggggagccccaggcaggagcggtagttgctggtggaggctgcaccagtggagggaggaggggaccaacgaggttgttgctggggtaagagggtggccaggaggacgctgagaaggacaccaggtgggcctgagcagggggaccaagcgcctgatgggctgtggggctaaggggggaatcgggtggctcccgggggtacaggctgggtgttgggtgaatgaggggactctccctctggggcaggaccacggaggagagcaggtctgcggggtggctttggggacatttgggagtaggcaccaaattgggccccgaagggatgagccgtgccttggcctccctgacagcttggcagtgccccctatcccctgctggccctgcccccttcccaggatgatgctgaaggaaccccaggggtttgtccagggagtgccacacttttcccgacagggcccttctgtgaccctctgatgcctcaggccacccatgggtggtgactcacacccaaaccccagccccacccaactcggtttggctctaggctgctctgggcccagtgagtcccctgtgaactgcccacccatcagccgcacccctgctccctatccctccgccgcagtcctctgccctctctcctcctgccccacctccacagggccggcatcacagttcagcaccacggttaagagcttcttcagaatcagctctgagctgcttcgcctcctcgcgctatgaccatgcagacacgattttggctccctgggcctcagtttcctcatctgtgcagtgggggtgctaacagccctgccctcgctggcaccctggcatgaggattaaatgaggtgacacctcataaagttctgggtgcagccccagcacgtggtgggctcaaagaagagagtgtgcataccgcaggaagggatcaatgacgtccgtaattcagaacacgtggggtccgctcagtgcgtggaggacgcccacctgccactgggcccagcacaggtgcctagatgtgaggctttgggaatggacggcgtcaggtgcttccctgggcctcagcttgccaggtttacctggggtgacgatgctgccataacagagctgggggaggtctccggcttgtctccctgtacttagcaatgcacccccactccactctatcccacagctgagacagagcagcaggggctgctgtggcagagcaggtgggcagcttggtgggcagaacctgcctttgccccatccctgtccagctggtgccaggccgtctgcgggaaggaaggccttggggctgggtttcaccctaccgcatccctccaagctccgaggtggggtcaggggaggctggcaacggatcgggcctctgggatcaaagtgtccggtgctatttctcttgtgcccgcgccagctctgtgctcaccctgggctgtgaggtgggagggcgagccgggacactctgactcgaggctggaattagaacttgggcggggggtaccaggctccgggaagcgctggactctgcttagaaattactctggtagtggaaacagcagccggggggttcctccagacacaggagggaagaggcctcccgtggagggacctgggtgcctggaagacgtgccctcccccatctcccctacctcacagcaggggcctcctgtctccaggagtctgtttccttacctggagaatgaggacaaggcccctacctattgctctgaagaggctgtcttggcctctaaggtacctgggatggctgctggcacagaacccgtgcccaatacaagggggtcctcccctacccacccccagctggggtgttcttggacctccatggccaaccctggggcaactttgccaaggagatgaccgcaggcccgggccggccgtgccaggggactgggagctggacgttctctgctgctcaggccacagggggtgctcagccagggaccctggaatgtggaggtccctcccttcttccctgctcccgccttgccaaggggatggagcctcctgaaataaccagatctggttagcgaggctaattttaaaagccactctggctgccccataggccgttctgggaagccatgaatgtccctgtgtttgcccctgggaggcagggcgaggggagagccctggggctgaggccggcctctgaatggactcccacccctgcctcccagggccggccagtctggggcccaacgttggggctcagggaccccacctctcctccaccccaatccactcaggcaaatcctagtgggctttcaggaccctccacccgcttcactggtctcctgaagcagctctgggcagggatccggaagctctctgtctccctctcagctgtctccccctctgtctccagtgctcagtctctgtggtgtccctttatctctgtgtctctgcctctctctgtctctgagtctcgtggtccctctctgcagctgtggctctctccccctctctccctggacccatcacacaggaggcgggatgcagtgttcctaagggtccatacgctgggctctgtgcactgggtggtgggcggctgtgcccacctaggagctggggtttcaggtgcggcccagcgagggagggaactagtcctggggaccaacaggagctataactgggcaggcaggagccaagtccagacacgacctgggccatctggccaggcccacttccagcaggaggaaagagctccaggtctagggttgccagatttagcaaatagaaacccacggtgcccagttaaatttgaatttcagataaacaaggaagaatttttagtttaagtataccttgtgcgatatttgggacatacttatactaaaaaattattctttgtttgtctgagattcaaatttaactgagcgtcctgtattttatctggcaaccgtctccagggaggctcttggagtgaagggagaggtttctcaggaaaggcaggttgcacaggccagtctgatggcagtgtcacaaccatgccctggagaaatcccagtctgatgagggaggcacagctacagaccaccaggagttggtgtggggacagtccttgggaacgtggtggggaggcacgtgacacacagtcttcttaatggaaccagagacatcagaaggaagggtctgtgtgtgcatgaatggctgagcccagcaccttgcacacagtaggggctccataaatatttgctgaatgaatgaagaatccggggaatggagggggatgcgcatccggggaatggaggggcagtagtaccctactgcccaagctcctaggaaccaagtgtgtgccacccccaacccagggactccccaatatgagctgcaaaggggacgggagggggcagagtgggtaaagagagatcagcttttcccttattttggcccctccccagaccccaatcctatgtgggaattcagccctgggcaagggtgcaggtggtggtggggactagggcaggtgatctacccttgtggcatttggggatggctgggatgaaggtgggggggcgcaggccagagggcactgctcagtgacgctgctgtttctcaggggcctcccgtgtgcagtgccctgtgccctagcggggtgttggacgagacaggggacccctggaacccgggaagtgaggggtccttgtttctgggcaggtgagacttgggcctttgtctgtggcccattaatctcaggggtctccctggaggtggcggggggaggcaactagggagagacctgtggccctttcatgcctccccaggggcagaattccttaaacagcctttttattcgttcactcattcattcacttgctaacaggctcgcttactcactcattgttgccattcactgagatgaccccccgaccgccccctgaactctgccccctgctcaggatctcaggcgcttgtccaatcccagcaggaacataccactggctcctggcatgacactgggcaagtcattgacccttcggagccttggtttccccagccctgcaatggggctacactagcagctccctggcaggattattgcgagaatgcgtgagatgttgcctgccccccgggagcacttccaaagggagccacggctgctgctggcaccattatcatcatcattattattattaatcattgcaaggcccccatgggttgggcaaggagcagccgcctggctccatgtccaggtcatgccgaggctgttctgggaagcgcccgcttccccttggggcgtcaatcatctcagttcccagccctccttttcaaggggtgtcagcgttttggcttctagatgcagcatgaaatcctgtagagaaaagtgagaggtggggatggagccgaagcctcgccccctcttcacctgcagtgtgaattccgggccttggtttccccagtcgtgcagccgggggctgggctgggcatcctgccagagcccagaaggggcctctccatgtgtcatcctgttagaaacggtttagctccgagcctataatcacatctacccggggaggaactaacacagcgtttctttaaattgggctctaattgcagcttttagtggagtcacatgcaccccatcccccagccggtctgaattagggcggctgtcccagcctgccctgccaagtacaggaatcccccaggattgctgtggctcccactgagccagcggtggatgagtccagggctgctgtttctcaggggcctcccgtgtgcagtgccctgtgctgggcgcttccgtctggggaactccttgtcatttcaccacctgaggatcaggcacttctgggacctgcttgccaccaggcctcctttctattcacccagaagtggggagccaggcctggagagtggggtgttggcgggcaaggccagaggccgtgcccctccttgggggcgtggtgggggagcctgtggtttccctgtttgttctggagatcccagccgcttccccgaggagacagctgacggttcccaggccacagcccctcaggcggggccagaccacggctggccagcctgggagcactgcccgccagccacccgggctccgccaggccctggcgctgggtggtctgggcaagggccaggggggggccttggtcctggccacagggcaggaaccgtgaccagagccaggcatggggctgccctgccagggacctagaggggtcctgaaggccacggcggggccaggccaggggcagaggccagcatgggcaaacactgccttggggagacccaggaggggaagactccaggccccaggtccatctacaggaggacctccagagagacactcacccccttcaggaatgtcccagttggaaggtttcaacccagccattgagttggctcagacaggagtccaccttagaggctggcagaagagtcggggttggcagacagaagacctagaccccagccctgccttccttcagacctcagtttccccatctgtacaatgggcaggggacacaacctcgtgcttgacatgggctcttccagctgaccaggctgtggatgggaggtgggcagcccaggctggaaggatctcagtcattcccacattcattctcagggacttgtctttctatttattatttgtttttgagatagtgtcccactctggcgccaagaccggagcacagtggcacgatcatagctcactgtagccttcaattcctgggctcaagctatcttcccatctcaccaccacacccgggactagaattggggcctcattttgttgctgaggctggtctcgaacttctgggctcaagtgatcctcctgccttagcctcccaaggtgctgggattacaggcatgaaccaccacatctggcctgaccaataggattttgattaggattacattcactttacttctttctttggttttgttttttcctcaggggcttctccttgccccacccctgagtcctgcggcaccccctgtaccttggatgaagccctctctgttcccagctgtccgggaaagagcccctgtgggtttcagagcctagcagaccccagttcaaatcctgaccactggctgtctgtaaccctgggcaagtcacttgctctctccagcccataactataaataccatcctgaccctcatctttctatttcctccctcgaactccagactcttttcctcctacctacccagccagcgtctccactccaaggtccagtgggcacctccagcccaatgtgatccaaacccaactgtctgttttctccccacttctggttccccatacccgtaaacagcacctccatcaacccaggtgcccagccccgattcccctgttccctcccctcccgacgtgcagtccaccagggagctctgctggccctccctcccagcatgtctgggatccaactccttcccgccaccaccacacttagcctggtccaagccaccaccacctccaacccagacagggaaagctccagactgagctctgggctcagctcctggagctccccagcctcctctgctccccagccactcgagtaatcaaagcacaagccagtcacttgtctcccctgcttcttttttttttttttttttttgagacggagtctcgctctcgctctgtcgcccaggctggagtgcaatggcgtgatctcagctcactgcaacctccatctcccggctccaggcaattctcctgcctcagcctcctgagtagctgggattacaggcacgcaccaccacacccggctaatttttgtatttttagtagagacggggtttcatcatattggtcaggctggtctcgaactcctgacctcatgattcacctgcctcggcctcccaaagtgctgggattacaggcgtgagccaccacgcccagctgtctcccctgcttctaaccctccagtggcttcctctctgcgaccagaagaagatgccagctcttttcatgccacatcccataatgcagcctctgtcccactcactgatccccgtttctctgggttccagccacatcaccttatttctggtcctcatttctgccccaggtggttgcacttgatctattgcctgcctggagccgttgttcctccaggtctttgcaaggcattgtccttgcaaatgtcactccctcagacaggccttccctgaccaccagctacagcagtgccccagtcactctctggcttttggttttcctatctgtaaaatggggccggcaccggtgttgttaagagggtgggaagagaccgttgggactgggggctgaagtgccagagtcagacaggcactgggtacctgtgagtccctccttctcacaggccggacccagggtcagaaggctgtgagaaccctttgctggagatggaagctgggctcctctgcccattttactgtgcggctgcaacttggtgctgacccttcctgggccgccttcctccctggaccatagcgaggccattccaggctgagctttgtctgggaacctgtggaaagaggcctttgccccaggagaatcttcgacagtggagggctcagagcacaaagggcccatctggcaccaaaactctcctgatgctggttgtcatgacggcacctgtcacaacctgagaggaggcagcagctagccaggccttggcccagggctctgggaggccaagaggggcaatgatcacacctcaaggcctccagaccctgccccaggccccttctctcaccctgacccagcactctgccccttcactgccatttttccccaaccaggtgacctgagtgggctggaggccgatgacacacctgcaggcagcgtggtcaagcccgggctgacttggggatccagaaaccctggagctgccccctggcatgggtgggtggaagctgctgggcactccccacaggtcaaaggcacagccatgggtgccctgtttacagtccaggaggacagaattcccagccactgaacccccacctccaccgccacccccacacctcaacccttgcagttagattcctgagtcgtcctcgttactcctccccacccacggcctccgagccctccccgcaccctgcctgcccacaccacagcacatgggaggcggcggcttcaagatcaaggagtccgcagatgagggcgctggactgcagccagtgggtggcagtgaccagccaggccccgaccctaggagcagagaatcggcacgtggtgactcacccctagacgttgggccctcctctccgcctgcagtcacagcacaggaaacttagactccaggaggagacacgacgtgggtgcagctgggaacggggaaaacccagcctgaagtccagccctgcccgacgccagaggatgcaacgggtgattaaaatcctgtactctgcagccacactgcatggctagagtcctggctccagcccttgttagtggtgtatcttcccataagtttaaacatttctgcttctgtttcttcatctgtaaaatggggaaaatcacagtccctgccctccagggctggttgcggggaagatgagttaatgtgtgctgtgaggcacgtgagaacagcgcctggtcagcagggaacgccgtagaaatgtccactcttgtgcccacagctatgttcccaccgcctcagtgattctaagcctcggttccagtggcaggagggagaggtgacactggaggaccgagtccggcccgtcccctgcttggctgggggtgccacgtgtgcccaccccatctgaaggttcacacagactgctgagaagccagaaaaggccctggcgctgtgatcaaggcagagtccctgcgaggctcagaggaagccacacaggcactcgggagcccaaatcctcttctgagaacttaatccccacccgccttccccagagacgggctctggctggatcctggtgggaggtcttcggttcagccacggggctaattacaaacgctgctgtctcatcaccccccatggtcacttttgggcttctggggggcccagggagcccatggttctgtggctcatggggctggggttgttttccttggagagattagagccccagagacaaggagaagaacatgagctgggagccagggagacctgggttcaactttcggctgtcacctacaagccatgggcccaggagcaggtcactatatcctgccgagcctcgattttcccatctgtgaaatggagggtgcccacttcagacgatggggagatatagaacatgtacccccaaggtgacaacttcactgctaggtcacagcactcagtagggtatgtggcacacagtaggcaccttactgcctcctgctctccaccccagagcgttagatttgctcataatccttttattcacctactgggccggcttccttctgataaacaggagctgggattcacagggtcaaatttggggcttgtccctcccctctccatttccacagctccagtttctcctgcctggtctattatagcagtgtctgggcgggtctcctggcctccagtttctctgcttgaagcgcccttgaaactgatggccaggatgatagttatttatttgagacagagtctctctctgtcacccaggctggagtgcagtggcgtgatctcggctcactgctagctccacctcccaggttcaagaaattctcctgcctcagcctcccatacctggctaatttttgtattttaatagagacggtgtttcaccatgttggccaggctggtcttgaactcctgacctcaggtgatccacctgcctcagcctcccaaagtgctgggattacaggcgtgagctaccacgcccagccaggatgatctttcaaaaacaatgctgactccctagctccagagccttccatgcctccccagggtcttcacggtcaaccccagcttctccaaatggcatttgaggcccttctgcccacctctccccacagcgtttccctctgaattcccctcagtagcctcacgccctggttcctcctccctttgttaagcctcagcttactcactgccctctgttccctgtgcacccgcccccaccatgttcccttcctgtccccacagctcctggcttcgacacacactgggatggtctctgtaagtctctgtcatgagatatgaacttgaggacagccttggacttgtccatggccgggcaagattgcggcacggggcgtggtactcaataaggcaggggccacaggctgtctctaccatgaccagacaggtgacatacatctgaaggcccagtgtctgtcagaatacaggacacgctgggggctgtggcatcgagaatagtgtagttccctgacagcttgtcgctcagctccaactgaccgttgccctgcagaaatgtggggtccactgctagctggatctcccttttttttttttttttgtatttttagtaaagacagggtttcaccgtgttagccaggatggtctcgatctcctgacctcgtgatccacccgcctcggcctcccaaagtgctgggattacaggcgtgagccactgcgctcagcctccctttttttttttaagccagaatcccagatcttatagagaatttcccaatttttttttttttttttttttgagacagggttacactgtcacccaggctggagtacagtggcatgatctcggctcactgcaccctcctccttctgggttcaagtgatcctcccacctcagtctcctgagtgcagggactacaggcttgcgccaccatgcccagctaattgttcatttttgggtagagaggaggtctcactatgttgccaggctggtctccaactcctaggctcaagcgatccacccacctgagccttccaaagtgctgggattacaggtctgagctactgtgcctggccctcagtgttttaaaacacggcacccgtgctcagcaatggctggggagtgtgtgagttggaggatgtctccagcctgagccaagttgaccatcccagtctcccacgcctcttccttcctacagagcagaggttttcaactgatgtgggggtgattctgcccccaggatgagaacctgctgtgttggtgttggtggcagcggtagcccaagcgaagacggcatttcctagctttcctcgcatccaggaaggatcacaggaccggttcttgccaatgcactaagggcggaagtgatgtatgtcacttccaggattaagtggttaaaaagcaggcgtggttcccaccatcaaggtgctggccagataggaaggacatccagaacttacagggggtggcagagccacccctggaaagatcctgggtcccagtcacctgagcaggggcgctgatgttggaggtaagaatacatcctcaggtgtcaagttattgagctttctgaatttacctttaacagaaggcagggttatctcagtgaatacaagagggcatgtcagctcatctttgttcttcctccgggagaaggcatctgagggcaaaagaaatccctgtgctgtgggtctggactgtcatccttagggtctaggtccatggctaccggccctagttgtgaatggagctgggacctatgcctgaaccccggctccaattaggactcagggcccacagcagttaaaatataaggtgatgagtgacccagggcccagcctgagcgtggggagaccctgaagccatgggtgcctgagcacctcaatctctgcttcttgaaggacacgtcatcccacagcctggagtgtgggcaggaggaactcctggctcctaatggggtactcagtcctcactacgtgctgggcatcgctaggcacagggcgtcagagaagctgaatcccttgcccaagttcgtagaactgagaaagtgatggagcagagatgtggacctccatctctcggactcacagcctgcgctttctaccccagcagtgtatcccaaagttcaacagaagctgctggtttgtgtcctttgagcagttgatgttccagcaccaggcctggaggctttctctcagaacttcatggggaaggtcaggagtgccagtgttaatttccccaggagcagccctcggccaatgagaggtgagagttgaagaataaatacccctgctccctcgccccttgggtgagatatctctgaagtgtcgctcccacaccatctcccagaggtccttcgtggggttgagccctggccagcctcagtggcaacctgtttaaaaacacatctttctcaacatccttccctttcctgtcttgcttcctcattccccaatttgtgcagctttctgggttcttctaataaacaaactgcttgtgctgagttctgtctcaggttctgtctccgtggaaacccaatgcaagataacaaagtgtggtttgtcagacaacccacagggagaaaatcttcacaatctatacatccaacaaaggataaatacacagaatctacaaggaactcaaacaaattagcaataaaaaaacaaacggccaggcgcggtggctcacgcctataatcccagcactttgggaggccaaggtgggcagatcacaaggtcaggagatcgagaccatcctggctaacacggtgaaatcccgtctctactaaaaatacaaaaaattagctgggcgtggtggcgggcgcctgtagtcccagctactctggaggctgaggcaggagaatggtgtgaacccaggaggcggagcttgcagtgagccgagatcgcgccactgcactccagcctgggtgacagagcaagactccgtctcaaaaaaaataaaataaaatcccgtcaaaaagtgggctaaggacatgaacagacaattctcaaaagaagatacacaaatggccaacagacatatgaaaaaatgctcaacatcactaatgatcagggaaatgcaaatcaaggtggtatcacaatgcgataccaccttactcccgcaagaatggccataatcaaaaaatcaaaaaaataatagatgtcgcatggatgcagtgaacagggaacacttctgcactgctgttgggaatgtaaactagtacaaccactatggaaaacagtgtggagattccttaaagaactaaaagtagaactaccatttgatccagcaatcctgctactgggtatctacccagaggaaaagaagtcattcaacggaaaagattcttgcacacgcatgtttatggcggcacaattcgcaattacaaaaatatggaaccagtccaaatctccatcaatcaatgagtggataaagaaactgtggtgtatgtgtatatactgtgtgtatgtgtgtatacatgtatatgtgtatgtgtatatatatatatatgaatatgatggaatactactcattcagaaggaatgaattaatggcatttgcagcaatgggattagagactactattctaagtgaagtaactcaggaatggaaaatcaaacatcgtatgttctcactcataattgggagctaagctatgaggatgcaaaggcatagaaatgatacaatggactttggggactctgggggaaagggtggcaagggaatgagagataaaagattacaaattagattcagtgtatactgctcaggtgatggatacaccaaaatctcacaactcaccactaaagaacttactaatgtaaccaaacaccacctgttcccccaaaacctatggaaataaaaacaaaacaaaacaaagtgtggtttgcacaccctggagacatgtaaattgacttcaggtggtactgggaacatttaaaaactgactgcttaaatgtcaatttaaaggagtgtttaggaaataatagtatatggccgggcacggtggctcacgcctgtaatcccagcactttgggaggccgaggtgggtggatcatgaggtcaggagatcgagaccatcctggctaacacggtgaaaccccgtctctactaaaaatgcaaaaaattagccgggcacggtggtggtgcctgcggtcccagctacttgggaggctgaggcaggagaatggcatgaacccgggaggcagagcttgcagtgagccgagatcgcgccactgcagtccagcctgggcgaaagagcgagactctgtctcaaaagaaaaaaaaaaggaaataatagtatggatacggcaacaattgtgaaggtggtgtgaaaataacacctggaaaacactgcattgtacagttcaagatgaggcgcttcctcttggtcctggccagaatgtatgcatatagtttcttttctttttctatgtattattttttgagacagggtctcactttgttgcccaggctggagtgcagtggcaccatctcgactcattgcgacccctgtctcccaggctcaagtgatcctccccctcagccctccaagtagctgggactataggtgcctgccaccatgcccccgtaattattgtatttttcataaagatgggttttgccatgttgctcaggctggtctcaaactcttgggctcaagggatcctccggcctcagcctcccaaagtagtttgattacaggtgtgagctaccactcctggcagtttcttttcttttctttcttttttttttttttttgagacggagtctcgctctgtcacccaggctggagtgagtgcagtggcacgaccttggctcactgcaagctccacctcccaggttcacgccattctcctgcctcagcctcccgagtagctgggactacaggcgcctgctaccaagcccggctaatttttttttgtatttttagtagagacggggtttcacagtgttacccaggatggtctcgatctcctgacctcgtgatccacccgcctcagcctcccaaagtgctgggattacaggcatgagccaccacgcccagccctgtttattttctttttaactagagacaaggtcttgctccttcacccagcctggagtgcagtggcatgatcatagctcactgcagcctctaactcctgggctctagtgatcctcccgcctcagcctcccaagtagctagattacaggcacatatcaccatacctggctaatttttttattttttgtagagacagggtctcgctatgttgcccaggttggtattgaactcctgccctcaagcaatcctcccacctcagcttttcgaagtgctgggattacaggtatgcaccgttgtgcctggcctatagtttcatcttttatcccagtgtcagcttggctgt

SEQ ID NO: 36503 - DNA, 3075 bp, Homo sapiens
cagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggttcgggcgctgcgggtcgggaccctccgtggccgccgcccccggagtccagggtccccacccccagggcgcgacccccgcttccgggcccccggacccgcgcgccccggaagccgaggctactcagccctggaccctcggccctgcctctgctgcccgagccctgcgctgccctcgtcccgggcacctccccgagataagcgtctcctgggtgccctccccgatctccctggccaaagcctgggtgtcgccggatcgttgcattcccatttcgcggatcagtagaatgaggcgcaactgttgaggaccaaagctgcaacttcggatccctgcgctgggttgtctcagtgcctcacatcagcgccaggtcctgccctgacccattacttagcaggacaggccgagtgcccggtgggcgcggggccggcctgccccgccatcattccccacgctgttgtctgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttggtgagtccggtggagggctgcagggccaggccaggctggggctccacatcccaggtcagtctccgtctcagttgaggctgcgagaaaaaatagttttaggccgggcacggtggctcaagcctgtaatcccagcactttgggaggccgaggcaggtggatcacctgaggtcagaagttcggagaccagcctggccaacatgatgtaaccccgtctcttctaaaaatacagaaaactggccgggtgcggtggctcccgcctgtaatcccagcactttgggaggccgaggcggggggatcacgaggtcaggagatcgagaccatcctggctaacacggtgaaaccccgtctctactaaaaatacaaaaaattagccaggcgtggtggcgggtgcctgtagtcccagctagtcaggaggctgaggagattgtgccactgcactccagcctgggcaacaagagtgaaactccatctcaaataagaaaaatacagttttagcaggtttgtccactgaggagcctgggctggccggtgatgaaagcgaaccagaggggaccctgctctcagccggtttatgactggctctggaccaaccaatgtaggatggtcgaagcaagagatgtaaaaccacccaggcccagtggttcatgcctgtaatctcagcactttgggagactgaagtgggagaatcgcttaagcccaggagtttgagactagccttggcaacatagtgagaccctgtctctacaaaaaataaaaagaaactgaccaggcgaggctgggtgcggtggctcacacctgtaatcctagcactttggaaggccggggtgggagggtctcttgagcccaggagtttgagaccagcctgggcaacatagtgaaatcccatactacaaaaaattagctggttgtagtggtgcacacctgtagtcccagctactcgggaggctgaagcaagaggaccgcttcagccggggaagtcaaggctgcagtgagccaagatcatgccactgcacttcagcctgagcaacaagagtgagaccctgtgccaaaaaaacccctcaaaaaaccatgttgggagggctgatcagattaggggaggaaggtcatttgtgcaggaaaaaaagcagttctaagcctcactggtttccagtggtggccagatttgaactcagcttgcctttggccctgaccccagctcaacccatgggtggtgggtcagagggagggcctctgtccccaggcagtgcttttgggggttcctccagcttctagtcctttcttgcggcccctgttttgttcttctctagcagttgcccgccatgttgggcccagggccagtcctgtgggtctgtttgcacactcaggacacagacttggatgtttgtggagctcctggttcacagggggctctggacttgaccaggggagtccctgaggctgtgcagccctttggggtctcacgccttccccccgccccattcccccagtgagcagcggttccatcgcagtgaacgccgactcttcggtgcagttgttggccgaagaggccgtgacgctggacatgttggacctgggggtgagtgtcagaggggacctgaggctcagcaggttggagctgtccaggctgcgggggagggagcgctgggggaccaggagccgggctggggtcgctgctggcccctcaccgcccctcaaccccttgcaggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctg

SEQ ID NO: 36504 - DNA, 130988 bp, Homo sapiens
cctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtaagcgccgcggctccgaaatctgcctcgccgtccgcctctgtgcacccctgcgccgccgcccctcgccctccctctccgcagactggggcttcgtgcgccgggcatcggtcggggccaccgcagggcccctccctgcctcccctgctcgggggctggggccagggcggcctggaaagggacctgagcaagggatgcacgcacgcgtgagtgcgcgcgtgtgtgtgtgctggagggtcttcaccaccagattcgcgcagaccccaggtggaggctgtgccggcagggtggggcgcggcggcggtgacttgggggagggggctgcccttcactctcgactgcagccttttgccgcaatgggcgtgtgtgtgtgtgtgtgtgtgtgtgtgtgtgtgtgtgtgtgtgtggaggggtccgataacgacccccgaaaccgaatctgaaatccgctgtccctgccgctgttcgccatcagctctaagaaagacgtggatcgggttctagaaaagatgactccctgcacgcccctccctgcacctcccgagcagtgattccgacagggccttcactgcccctgattttaggcgggggccggccccctccccttttcctccttcagaaacccgtaggggacatttgggggctgggagaaatcgaggagatggggaggggtccacgcgctgtcactttagttgcccttccccctgcgcacgcctggcacagagacgcgagcagcgccgtgcctgagaacagtgcgcggatcccactgtgcacgctcgcaaaggcagggttcacctggcctggcgatgtggacggactcggcggccgctggtccccgttcgcgggcacgcacagccgcagccacgcacggatgggcgcggggctgcaggtgcatctcggggcggatttctttctcagcgctcggagcgcagggcgcccggcgtgtgcgctccctgccggaggcgcggggctggcgcgcagggctcgcccctcactgcggcagtgggtgtggaccctggtgggcgaggaagggggaggataggctgtgcctcctcccactcccgcccccagcccccctttttttccccctcggaacgcgaggtgccatcttttttcggcgtgtcacgtctttacggtgccatgccaaaccgggtggccgggcttcataggacagggcggggcctggcattaaagggagggggacaatcagcgctgaaatcttggcgttttgctgctgcgggcgtgagcactgggggcgttcgcccagcaccttcttcgggggctctttgctttgtctgtagaggttacgtgatctgcgctcccagccctggtttctggcttttattctgagggtgttcagtcaacctcccccctacgcccatgcgcctctctttcctttttcgctcctcatttccgagcccattgttggatctcgaggcttgctgggttcgatgaactcgagtcaaccccccgacccccggcacgcatggaacgggcgtgaccgcgcgcagcctcgtctcggagtctgccggcgccgggaagcttctgaagggatgggattcgagtctccgtgcgcgctgcgggcggcggcagagggatctcgcccctccctacaccccaagtgtcctgagggccacgccacaccaggttgcccagcgagggacgctggctacccatccggggatgggtggggagccctggcggggcctctccggctttacgccctgttgcttcgcctggccggagaatgtgaggaaggggcataaggttactggtgcttcggccacacccatctttctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcacccgtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgcccccagacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatggtccaggctggaagggatgatgggggctccgacagcgactgcctagctcacccctctgcgtgctcaggctccaggctcagcaggaccaatttgagttctatctgatccccctcggccccttaactgacccatcctacaggagacagggaaatgtctttcctaccgcggttgattctggggtgtcattttgtgttttgtgatggctgcttatatttactgtataagcattgtatttactgtataagcattgtattataattactgtataagctgcttatatttactgtataagcatctccaaatcctccctctacgtaaacaaattaatggataaacagataagtgtatcccctgcccccacccctgctacgcaggtccggagtgactcttgaagctcatacattccttggccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaatatcaggcattgctcctccgacaggaacaaaagaaatggatactgcccataaattgttagaaaacttagaatcgctttgattgaggaaaggttagatttattccggttggaaaaagtggcctttctattaaacgtgccctttgaccctcatgcccttggaggtcggtgccagcctggagatgggataagattgtggttttccttctgcctttttaacatctgttgttacagtccatttgttgaaaatttaaagaaactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggtattcggtccataccaaatggattttatccatgaaggataaatggggaaatacagtgggaagcaggtgggaaactgcgtttgactctgctctttcctccaccaccactttcctcatcaccgtgttcagagacccccaaagccccctcacactcccagaaacacccccctggccactcctaacttgccatgcccaggagttaggtgcttccactagtgacatggagctggcgtttggggggcacctcagcaggtgacgggaagagaagaccccagcctcaccagctgggctgcagcagggagaggagtcctcatgttccagcagggactctcagctgttttcctgtaaaaccatggttctcaactgggggccactgagatgtctagagagatgtttttgttttcacaactcggggagggtgctactgacatcttgtgggtagaggccaggaatgctgttaaacatcctacaaggaaggcacaggacagtctcctacatcaaaatatgacccagtcccaatgtcaccactgctggggttgacactggcactgctatcttaattacattcattgagtgtcttttaggaggccctattctaagtgcttgctaagattatctcatttaatcctcacaacacttccgctatgtagcaggtgctgttattatctccgtgatggggaaactgaagcacagagagggttagtaacttgctaaaggtcacagagccagtgggtggtggagctggttgcctgacactagttccctcccctctcagccacatgtgggtttacttggccattgtggactagtctgggaacccagatatgatctataacattgacccagtagaatattgattccaaaaccactgtctcacaaatgaatttttacaagagtctgtaatcggagcatgacccagaataaggttagggagatgtggagttaaagctctcaatttcttatctggccccgacacagagagcaaggcatttcactctacattggtgctctgtttataaaacaaagagcaaatatctcttcctaaggtccttaaacctcttcccccaatccagggtttctggactgctctgccatatgacggggcagctggtttgattgacccagggaaggctggaaatcaagactgggggatcaagacgtagattcagtgtggccaaggtcaagtctctgaggtttagggacatcagatccccagcttaggttctgtacctcggcaaggtgaaagcgttggcgcccactgatgaggcctgctctgagattgtgggtgtgggttgagttgggtgggcataggcaagtcctcttgtaagaatcttttggcaaagatgggcctgggaggcttttctcacttcctggggcccaggctttgcaataagtattccattatactgtggtaccttggggctacctgagaatcctctgtctcgcccctgttgccttgccaaagagtttgctgtccaagaattcctttcctgtctccaggtgccatgctcctgccacctctgccaggttccctgcctgcccagatggctcccaactgagtgtgaggaggaatttgagacaggttttgagctttctgggttctccagttaggaaactttctgtaagcatgcagatagaatgggcttcagcaaaatacaaactcgaacaacttccatgtatagtcccttaattttctttgcttttttcatatttcatcaggctccatgctgagcccaatcagggacccgatagaaatccaaacaccatgtcagcgagtccccaagaaatgcattttgtgccaaggctattcaaggaaggtttgggagcagctcaagggcagacactgttaccctcccccaggtccccagtgcagggcagtgttctgcatgtggaggcagtttggcctaatggttaaggaggtaggctctgatcgggcctcctgggcacaaatcccagctccctgctcactgtgagacctaagccatattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgtcctgtggatgagtgcttgtgattggctgaatgaccagaggggtctaaagatcctggtgatggaatcagttgtacagataaattgttacactgagtagggatcaagataggaaaagtcggcaactacccagctcccctgcaccaaactgggcagaagtggatcctctgaaaattgcacacacccatgtttaaatgtacacacagaactcttgccacaggcaagcggagatttgtcatctgctgtccctgcctcatcttcttcctgaaatccactccatgccaggaataaactgcatgctctccaccagcccaaactgacctgccttcccgccagccatcccgggcagggtgacctggcttagtacatcgggttcagagatctttccagtttactcgttgaataaaaagtgagggctgatcgagaaagtaatggcagtcagggaaggcgaaggaggtaaagaagagattttacaaatgaagtaattcaacagagtgctgacattggtaaactggcaaacagatttcagggtggttggttgagagtagagtagaaaaggattaaataaagcaaacttgtggtgtactgaatcttaggaattccatgtatccaataagtatagtcatttatgaattaataaattcggcctaagaagccttcttatcgcttaaatcaagactaagtaacaatatatcagttttaaaaagtcattatatcagaaaatcatttaaatgatacacatagatttccaagattttactttaaccgaaactatataaatgtgaatttgttcacccatcttttgacacagggctcaggtcttctcttggtgtctggatcagccagttgaaatttcttgtctgttttgcctatgccacattaataatgcactgtctgggtcctccgatttcagtttggattttgggtttacattgtggagtcatctgaatgcagaatccttcagggattttacttttttttttttttttcatggtctttaccatcccatttgatagtaaatattactcacctttatgaagtctttccaaaacattcaactaaattttcttaaaatcattgaatgatttgaagagcttattcctcagcacttttactccatcagcttgcaccttattttttaatctttttttgagacggagtctcgctctatcgcccaggcttaagtgcaatggcgcgatcttggctcactgcgacctccacctcctgggttcaagcaattccgcctcagcctccgccgtagccgggactacaggtacacaccataatgctcggctgatttttgtatttttgtagggatggggtatcgccatgttggccaggctggtcccgaacttctgacccaagtgatccacccacctcggcctcccaaagtgctgggattacaggtgtgagccaccgcgcccggccagcttgcaccttatttaggatatgtgattattatagcaagtctggtgtacatacaagattttgaatgggcacagatgacctttagtaagtgcttggctgtgataagaggcagtcctgactgcagatcaggctgtgtggaccccagccttgcatgtttacagaccttcatgtcttattcttacagggtatcagaagaacacctactggggaaacttataaattagtaaaaggtgggcattctccccgcccatcttctgtctgtctgccaggactagcacagcactttgaagtcattcacatagaatcccaacttaagagggtaaaatcctcctcaacagactgaaaataagtttaaattccctttgctatattaactcccctgaggaaagagtcttagatcaatgtccaacactaaaaacagttttaaatcagcaagtgagaattaaatctgaagcaattgataataatgtttcattcattcctctcctttggccccgtccaccctactgctaaatccaggcatcaaagagaagagggacataattatctctagtcccagctgctggttttccttccagcctatggcccagttttctgttttactgagaaggctggtgatgttatcttgggatctaagtctgcagtttcaccacaaaaagtccagggatgcactttcatgcttgtgtcctcctccctgggatagcaaggatattagaagacccctggctctgtaattgcttgtcatgtgctctacagacgccacagaatgccaagaacgaagtgctgggaaggacaaattcatggaaccgtgggacggtgctcctcccccagcgtaaaggacagctcctcctcctgaattggagccagcgttctaaatcatgtgtcaacagagttgtcctggatcggatccagttctgccattgatttgcaggtcatttcagtggtacctgtttccagttgttcttaattgaacagtggcaccaaactattgtcttgcctcatccccctcccatggcctgtcccccaaaaagagacttcttgggtaattaatcagggcaacatcaggcagtctgggcgcggtggctcacgcctgtaatcccagcactttgggaggccgaggcgggcagatcatgaggttaggagattgagaccatcctggctttgtgaaaccccgtctctactaaaaatacaaaaaattagccgggcgtggtggcgggcgcctgtagtcccagctactcgagaggctgaggcaggggaatggcgtgaacccgggaggtggaggttgcagtgagccgagatcgcaccactgcactctagcctgggcgacagagctagacttcttctcaaaaaaaaaaaaaaaaaggaatctctttggttttatatatttttttttatatatataatatatattaaaatataatatatatatttatataatataatatataaatatattatatattatatatttttatatattatatattatatatattatatattatatatttatatatttatatattatatatatttatatattatatatttatatatattatatatttatatataatatatattatatattatatattatatattatatattatatatttatatatattatatattatatatattatatattatatatttatatattatatatttatatatattatatattatatattatatatttatatattatatatttatatattatatatatttatatatattatatattatatattatatatgtatatattatatatgttatatattatatatatttatatatataatatattgtatatattatatatctaatatattatatatattatatatattatatattataatatatattatatattatatatatttttatatatataatatgtataatatataatatatataaaaacatatataatatatattatatattatatatatattatatatattatatatattaaatatattttatatatattatatatattatatatattaaatatattttatatatattatatatatatacacatatatatatataaatgaggccaggctcggtggctcacacttgtaatcccagcactgtgggaggatcacttgaagccaggagtctgagactagcctgggcaacaaaacaagatcctgtctctacaaaaggaaactgtaaaaattagctgggcatgatggcatgtgtctgtagccctagctacttgggaggccgaagcaggaggatcgcttgagcccaggagttcaaggctacagtgagctatgattgtcccatagcactccagcctgggtaacacagcaaggccctgtctctaaactttttttttttaattctatttatatttacatgtatttaaatgtgaatattcactacctatttgttgcatgcctgcattttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggtgtagtcgcatgtgaacctgtccctttcatagctgctcattgccaggaaacatcaggaatagccatttggaagagtcatcagccctcccaccatccgttttctgtcttgtcttttccctatgagcaggggaaattccacgctggccccaatccccagtgcagcggctcagcctctgcctctgctgctggtccccatgaggccagcttagaaacggaggattttgcagaacatccctaaatccgcttgaataatgaagtgatcattcataaactcacctgaaccttattaaaacctatttaatatttttcctggataatcctatagggataacttgcctcctgggcttctctccaccgggttcagttcttcctttagtggtgaagttcctcccttcttagcatctcaactgtgcctgagaaaaggccagtggcggctgcactctgttccctgtggagtgttaataaagactgaataaattgaaataaatccctttcaatgtcattaagtgctataaataatcatgaaccaatgttcgatggctgatgagaaatgcaagaaaaaatttttaatcagtaggattcataagttgacaatctgggccaagttaaaaaaaataaaaataaaaagacttttaaaaagatcttatcgtttgttaccagtaagactgaattccagaagcaagctactccctcatttgtgggcccctgttatcactggctgcttagggttgccaagccctgaattcatttgtcaactaagagatttttggccaagattaagatttcccatgcctccatatttccatctgagaaatggagattatactgtcttccccctcagaatggatgataatgtggtctctcttctgttcgcatagtcatagaactgaaataaaacaacttaagagaattcctttgagcttctcagaagtgctgcagggctgggggatgcctcccaggagccgcagtcaggtgctgatctgaagtctttggtgggctgactttagcctgacctgaaatagtatagctgctgccacctggctcccttagcgtcagtcagacggtgcagctggttcctaggggtgagggctgagccagcagggtccgtgcccaggagggatgcatgggtggccacagcccagcctgcactgatcttgtctgtccccttctttggaaggaaggagccccaaaccagggtgcaagacagtgggtgggggtgccttgagcatgacctcaagtgatttccagcccctgccagtgctgacttctctggggaagggctgggacttccttctgggctcaagtcacgacccttggatggaatttcctgggagcttttctgttttttctggagttttcagttttttcctaaccagacagggacttggtacagaatctcatattctaattatgcctaggagcagcctctccccaccactcacagtgtttagcatgtgacaggaatcgattaaggcatgagtgattaaattaaagccaggcattgacttggatggtgtaatattctgacatctgtttggtgtcaaaggcacggggcaggcgcgttaattgaactgcttgcacctggcatttgaattgagccagagcggggctaaagtcagtttgccttcaccctgtaaatggagggtttctccggagcgtggatggtgggaggtatttcagggtgtatgcataacccccaccctgacaatggcccatctcttctccagcgtggccaggtttgagtgccagtcctgggtgtccagtggccccatagccttgcgttttagtaaaatgctgcccccattaccacctggtctgtgcacttcggtcactggaatttgccatcttccagtcccgaatgtggcaagccatggagccttaagctcttctccctccacatcctggaacagacccgccagtttcttccaggcattgcctcagtttgcccctctgtttccagtcacactctcaccagcgataaaatgattttagaccttatcatctcaccctcggatccttatggaaacaataatgagttgttccctgtttcaattccaaaattcatatccaatccgttttgcatgccattgccaaattcctcccagagcaaccccgtcacctgccctggccctctccaagtgtggtcctgccatgggcatcgcctgctaagccaagctggcctcgagctgcctgcccgggtccccacaccttggctcacctccctgcccagtcccgcctcctgccagcctgccctgtggctccttcatagatgccgtgctctttctgccccttgctcacccatggcagccttgcccctctctccctgccccaccccctatttaaattgacctgaccttcctcagtgtccatcttccccgaagctttccccagccttggcactcaaggtccagaggctacgcgtttcctctcacctgtggcagcgccgtgctccccagtgcctcacagtttccttcttgcccccgcttcctgtgtaggactcatctgcccacaggttgcacgtcctgtgagggcaaggactgtgtcttatgtgactttccttctccagtcacagagctgggcacatagatagctcaaaaccctctttattaacacagttggatgttgagaaatcaaacaggccaatgtcaaatgagctctccttatttaaatcaagtcagttctccacctcctagcactcagttccagtactctatatacatggaaataataaaaaacacatttcctttgaaacattctataatcgttcctttgccctacttcagaccaacttaacgcactccccattggtccaaatgagttttgctatacgaagatgctgataataatagcagcagtggattattctgctaaaaccattgcctcgttaatcctcagtcccgaggtggggattattatcctcattttgcagagaagcaaactgagactcagagatttcacagctggggagggagccagctcatccctctgtccaggcccaagctctctcccgcttgccttcctgcctctgcaacctcagagcatcccccatctggttctactgcctgtgctagtcgtgcaggagccaaaagacacgtctttagtgctaaggactggagaagccatgccctccagcctctgtgaatgggtcatatgtaacatgagcctggagaaattatttgaaaccaaaggcaagcctctaaaccaggctgctgcttcatggcgccggtgacggcagaaccaaatttagtgctgtgggcaggtccacacttatcaaatagagaagctcatttttcttccggctcacatcaagcatgaaaaatgttcacacataccccccacacacacatgctttccggaggggtccatgtggctagaggctggaagatgtggatgagaggagcctggcaggtaagcccagggaagatgacattcagcttcccagacagcatctacagggagaaatttaattaaaagtggggcggtttccctgagcaaggcagacaaagtcagccctctactgttaagaaaaagggtcacagtgagaggggaggtgaggagactgagtctgtattttctagtctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctcagttctggtcttgcctcccacgttctcctccacatttaagaaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctgcagagtgcgggcaccttggcacacagccctgagtgcaaaattaggagctgggcagagggcatctctctgtcgccattgggcagcccagggcacactggtcatagccttagaccacgaacaccctgtgcccgggggacagatgcaaccagtgtgccctgggctgcccaatggcaacagagagatcgacacctggaccccatgtcacggggactccactactaaggctcctaagactgccaccttccagtgggataagccctgcctcctactgggcccacaatgtgcagagaacacttgggactacctggctttctggatacacaaatattgatccaatctggactaattagaaggtcagtcccaataacaaatcgaagtcagctgggcgtgatggctcactcctataatcccagcactttgggaggctgaggtgggcagatcatttgaagccagaagttcaagaccagcctgggcaacatagcaaaaccctgtctctactaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatgatggcatgtgcctataatcctggctactagggaggctgagacaggagagaatcgcttgaatccaggaggtggttgcagtgagctgagatggtgccactgcactccagcctggttgacagagcaagactctgtctcaaaaaaaaaaaaaaaaaaaaaaaaagccatgcctggtggagcactacgtgtaatctcagctatttgggaggctgaggcacgagaatcacttgaacctgggaggcagtggttgcagtgagctgagatcgcgccactgcactccagcctgggcgacagagtgagtgagactccatttcaaaaaaataataaatctgagtcactttaatattgttatttggatgtcaacctctaggtgtttgagacaggagagtgatatgggggcactggaaacacacaggcacggggtgtcctcacacttgggtagcccacacgatgtgatttcagggtgctgggaggtccccccactccccaaattactaacaagtggatagtactttacagtttatatgatctcatttgattcttaacatgagcctgtgagtgaaaaattccttcccctcttctacagattaggacgttgagattcagggaggttcagagggattcagggaagtcaagtggcacctggagtcccgtggctaatttgaggccggtaggggattcgaacccaggatttgtgcttcttatgcctgggcttctgctccctggggcatggtcttccccctagctttcccattcactgctttagcctaggggtcctaccctttattaaactgccagtgcctcactgcttttctcccccaaagacaaaaaaaaagtgtttttgcttttgttttgtttttcatgggcagagacctggaatttcagcttgagaatttgtgccatatgataaataaatcaacagatggctttttccttaaaaaaaaaaaaaaaaaaaactaagatgtatttgcagtgaggcataatttgtaccaaaaagtgctcaccacactgtagtcatgggggcaggaggcagccgcgggtgaagggagaaatcttggagtccaggcagcccccttctgggctgaactggggagctgggggtgctgccagccctgccaggttctcctaggaggcggcagctcatatggctgtgggaggaggcagagggagcctcatatgcacccacatttccagggatctagaagacagaaggaggaaaaccaccatcatgttaaagcagacagttaggtaacacatcctgtaatacaagttattttttccacatctaaaggctaaaaatagttgttagaatttaaagataattggtaaatgagtttctatccttctagtttcacatcaaatggaatcatgctgccttcacatcactagtgcccgttatttgtgtttaatttccacaatgttgtctaattccactctttgggcttccccagggatccagcctccctcactcgcccatcgcagggagatgctttattcatctttgtgtcttctgtgccgggcatagcgcatggcacagaataagcactcagtaattgattcacgagtgaataaatggatgagtgggtgagttcaatattgactacaaaaaccctaaggccacactggtgagtggctgcgcctgtagtcccagctgctggggaatctgaggcaggaggatctcttgagcccaggagtttgaaactagcctgggcgatatagcgagaacctgtctcaaatgacaaaaacagggccaggtgcagtggctcacgcctggaatcccagcactttaggaggccaagatgggaggatcacttgaggccaggagtccgagaccagcctgggcaacatagggagaccctgtctctacaaaaaattttttaaaaattagctgggcatggcggtgtgcgcttgtagtcccagctactcaggaggctgaggcaggaggatcacttgagcccaggaaattgaggctgcagcgagccatgatggcaccactgcactgcagcctgggcgtcagaacgagacctgctctcaaaaaaacaaacaaacaacaaaaaaaaaggctttcttaaagagacttgagaacagaaaggggaacagatacataacttatatatttatttgttcatctttccaccttcctggagggtggaggggaacaggtctgtatttggagttttgaatgctaaaagtgggaatacatgtactgtttgccatgatctgttcaaaagttaagccaaatgccttagattctcctgaaaactggaatgccactgtaaactataagccccacttcaaagataaaagatcttgatgaacagggctgggtctgtggactgggcctctccccaccacacaaggaagggtggtgccagttgaaggaaaatcacttaaatccttgctgtctcctaataaggtgtggtcccaggtagggctgtcagaattagcaaattaaaacacagggcatctgtgaaaattagaatttcagataacaacaaataattggcataggctgcataatgtccctcaaagatatcaggtcctaatctccagaacctgtaaatgtgatcttatttggaaaaggggtctttgtagatgtggttaaattaaggattttgagatggggggattatcctgtattatctaggtaggtcctaaatgcagtcacactcatccttgtaagaggaaggaagagagagatggaaaacacagaagagaagacaatgtggtgatggaggcagagattggagtgaggtggccacaagccaaggactgctggcagctaccagcagccagaaaagtccaggaaccaattctctcttggagctccagagggagtgtggccctgctgacaccttagcttcaacctagtgatcctgattttggactttggccttcagaagtgtgagggaatgaatatctgttgttttaagccaccaagtttatggtcatttcctacagcagccacaggaatcaaaaacagtaagtatgtcccatgcaatgtttgtgacacacaccaaaaatattacttgttgttcacctgaaattcaaatttaactgggtctcctgtattttatttggccaacctagttcccaggcccaaagaaagaggcttttgaaatttgcaagaaagctggttggagctgtcagaaagtggactttgtaaacacagtaccaccgaaccaatttgaactgtactacctctagacaaaagagagggcagtcagacagttgttcgtgatttcttctttcaacagtcatttgagcacttactacaaaacagaagctatgtgtaagggtggaggcgttagctgttaatcaggacctccaggctaagtttctgtattagtccgttttcacgctgctgataaagacatacccgagactggggaatttacaaaagaaagaggtttaattggacttacagttccaagtggctggggaagcctcacaatcatggcagaaggcaaggaggagcaagccacatcttacatggatggcagcagacagacagggagagagagcttgtgcaggggaactcctctttttaaaaccatcagatctcgttagacttattcactatcaagagaacagcacagaaaagacctgcccccatgattcagttacttcccaccagatccctcccacaacatgtgggaattcaagatgagatttgttaccatatcagttaccaacccttccagataaatcacgtgaaatatcgccattaacagagtgagctcaggtggttcttcagtgcatttctgatacctgaaccttccctgggaatttcacagaccatcaggctctccaccctttgatagcaggatagcagggcccaggttctgcaggaggagatgttaccacaggcctgaaagggagggaggggcagatgctacaggaagatgctggctctggattcgctggaggagctttcaagggaagtagatacacactgtctccatcatttcatgtccatcacactctaaaatgctttggacaagaagcaaatgttaaagacaaatgtggcccattttcctgtacaaagagggctgctcccatgccaggctattggcactggtgggcatgaggcttctctgctgccctggccggggggttctctcactcaccattggctctctgacacctggagagaccaccacccttgggctttcatgatgctcacagaatccacactgttggagctttaaggagcctggatcaactggaacaggcagggagtactaggacagcccagcattgccccaaaatatccaggcctgataaaagagaaaaacaggtagctcacaggaaaaggataaaaaaaggaggagggatttaacatgaaaaggtgcttgatctccctcataataaaaagactgctgattccatccaggcaagtgacagaaaaaaaaaatttaatttaaaaagactgctgataaaaccacagcgagacactgctgctcagggatctgagggtgtgggcagccaggctgccacgcatcatgggtcggagaggaagaccacacccctggagcagagggcggctgatctgtcagatgccctttgacagcacctcagcttccaagaattaaccctttctatgtgagcagaggcatccatggggggacacactggtgaatcatctgttatgtagaagtctggaaaacatcaggatggaactggtgaaataagtgtggcctctgacggaatggagcggtccgtctgcactgctgcgggtgcccctcagatcctgtgggtcagtgagaaaagcagtgaggaacaaggcaggtactgtgtactgtcctctgcgtgcaaggaaggccagcgcatgcaacagagtccacacagacatagcctaactctggaaggaagaatgagaatgcagtttcagtggtggcctctggtggggagaaactgggtgaagggagatgtcatttccatttctctactattaattttgtattaccatgcttaaatgttactttttacctttttttttttttttgagacagggtctctctctgttgcccaggcaggagtgcagtggtacaatcatggttcactgcagcctgaacctcccaggctcaagcaatcctcccacctcagcctcctgagtagctgggactataggcacgcataccaccgtgcccagctattttttttaatcaagatggagtttttctatgttgcccaggctggtctcaagctcctggactcaagcaatcctcctgcctcagcctcccaaagggctgagattaaaacgtgagtcaccctgcccagccaattgctttttaaaaaagattaaatgcatgtatacgctcaggcatcagcacacttggaaaggatgaaaatatccggaagaagggttcttttaaaaggctcctcaagtgatgctggcaggcatgacgaatgtccctggtcacaaaagctctgatctggcctaaccctgtcatgttagagactggagtgcgtgtgtgtgcgcgcaaagtgtggggggatgggggtgagtgtgtgtggtgtgtaagcatgagtgtgtatgtgtgtggtgtgggggtgtgtgctgtgtgagcgtgtgtgagtctgtgtgtgtagtgtgtgtgtgaagtatgtggtgtgtatgtgtgacgtgaggtgtgtgtggtgtgtgagttgtgtatggtgtgtgcatgagcatgtgtgtgggcatgtgatgtgtgtgtggtgtgtaagcatgtgtgagtgtgtatgtttgagcatgtgtggtgtgttgtgatatgtgtgtggtgtgtgagcatgtgtgtgtgatgtgtctgtgtgtggtgtgtgtgagcatgtgtgttgtgtgtgtggtgcatgtgtgtggcgtgtgagcgtgtgtgtgcattgtgtctgtgagcatgtgtgagtgtgtgtgtgttcagcatatataaggcatgtaactgaacacagcactttagagggctctcctggagtcagagggggtgggtaggaggagaagggaggtgggctagtgtgctgaagtatctactccttgtcatagtctgtgacaacccagactagcccatgagccaccctgttccctgcatttccaatgagacctcggtggacatgttccctgaggtgaggctgactgatgtcatttgacgatcttgatgccaaatccttttatatcaaaaacaaccagaacactctcttttctcttagtgctttcacccagatgaccacatttcatcctcccagccactctgggccaggtggcactgctggtttgaaagggaggtctcccctggagtaacttccgtgggcggattcacaccctgcccacagtcctgtcccagtcagcccaccatggtggtctccggttcctccagaattcccgcttttcagctcatccccacattcccggagggactgagagcgcagccccagggccctgctctttgggggccgtctctacacccagagaagcagcaaggcattcctaggtttctctttcagatgcagaacttcagtgttcagagatgttcccactggtcctgagagggctcagttcagctttaatgactgcgctgttgcgtgtgctctgcagagggcgggtggcccagcgtggctgactgcagttttcctgacgtggagcccgagcctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctccctgcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaaggggctgtagaactgccagcccctttggtccatccgtaaagtgaactctgtggatcctggaggattccagcgtctttttttttttttctttttttttaagacagagccttgctgtcacccaggctggagtgcagtggcacgatctcagttcactgcaacctccgcctcccgggttcaagcgattctcatgtctcggcctcccgagcagcaagactacaggtgcgcaccaccatgcccgactaatttttgtattattagtagagacgggggtttcactctgttggccaggctggtctcaaactcctgacctcaggtgatccacccgcctcagcctcccaaagtgctgggattacaggcatgagccaccatgcccagccagcatctttcatttttctgtctgctttggccctttcctctctcactgtcttccttttccatttccaaagtcagtccatctcactattagcacaaaaactgctagagcgcttgtcattggtcatctctccctgcacctggctggtctgttcttggccactgaagcgtttcccccagctgttgctttaatcattttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcaccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgagctcacacccagagctggctccgatgaccctgtctcctttacatgtttctaccttcccctccctaccttcccccactgctgggcgcagagtggaggcagatgaggtttaaagctcagaagggcttaaacgggttggggcgcagtggctcatgcctgtaatcccggcactttgggaggccaaggcagaggatcacttgagcccaggagttcgagaccaacctgagcaacatagtgagaccgcgtctctacaaaaaataaaataaataaaattagctttgcagggtggcatgcacctgcagtccctgctactcagaaggctgaggtgggaggatcgcttgtgcccaggagtttgaggctgcagtgagctatgctggcaccacagcactccagcctgagtaacagaatgagatcctgtctcaaaacaaacaaacaaacaaacaaaagaaggcttaaagggggctccaggtgggcttggcagcacaaagctatgaagttctatcttagacacaagttctgttactgggcctttgcaggctggcctgggtacctggctgccatagacagggaaccttccagatgagctgcaggcgtggagcacaggagccagggtgctcttcctgggctctgtccacaggcagaacgtacacagtctttgtacacgtccggcggctctggtgcctatttttgtttgtgtttttcttttgtttggggggatggatttggtttcccccgagccctctgtcctcctgtcacctggctggtgctcggcaatgttgaccagctgcctggctggagttggcagtggctaaggctgtgacagctaacatgttcctgagtcctctcatttcttcaccataatgccctgttgagtttgcagatactgtctctgtttttatctcccggggaaactgaggctcagagtggctaggccaccttcccatggtccctcagctcatgagggccacacagggcattgcggtggccttctcctcagccttgaccctccggccccagcattgctgcctcaaggggtctcctctgctgagccgtgcaccttctgcctggcagctccaactctgtggctgtgttcagtggctcagcactgccccttgaccctccctggccttctgcggatgccagactggagcactctgacaaggtctggggtggttgtatgggtcctgtgacctctatacacctcccagtgcctgggaatcctgcagatacaccctccttagccgtccctaaccatagaggacatttctgaggtccccgagagagtggggcacccctgcaggatccaactgctgggcccaggaaggatagcagcagcatgaggggttccattagccacaaactcacggcatggaaccttcacccacctcgcccctcatctgctgtttagcacctggcacgccgtgtatacttactgattattacattttaatggcaaattatagtggcaaacgtatgcatctttgcacaattgttgtacagcatgatgaacaagtcattaatagtaaagaataaatgtgaaagtgagaaaaatctgactgccaaagtttttactccttccttccctccccagacttttaaatgaaagtttagggataatcccttagttgtcctgctagtaggacttgcaattaaaagaattgggccaagaacacttctacgcttctccttttaggtttgggtgtaaattcggggtatttctcactgatgaaagcctggtgcagggcagaccgtgggaagctttcatttccggaatggaccatcaacatcccttggagaagaattctcttctccagacccagacctggtgtcctggcacccattgggcaagtgggtcctagaagacaaacctggtcagagcctggaggctgcttagcattccccacgcacattagcagctcggagagctcaggaagccgcagcccctccttgcctcaccagcctggatcaggacagcatcccctggaagacacacagggcctggcctctgattacccagcctggagggaaagctcaatcgagcatcatgtcacccggtgcccccatgcagggtggcactggtgagacccccaagccaatgataccacctcacaggagtgcaggcccattgtggccagatcatcttgacttttcaagataaatcagaaatcgtatttccatgagatatccctatttgcaagtgatggtgactaaattagaagtttttgaatattgtaacatgttcgtaggctgtttgtctggtttaaactctatctggaggaattcaagctagacttcaggaataacttcttgaggcaaggattttgagaccttagggaaagaaggacgtcttgggggtattctgactgttgtcctcctggaagggaagaacagagaactagaagactgcccttagcgaagttcaaagcacctaagcccgggaccctcagcaagtgttcttgagtcacagattctccctgaggcgcctctttctggctccatagaatggctgattctgtaactcggtgagtttgctttttttttttcctccatcacccaggctggagtgcagtgaagctggagtgccgtggagcgatcactgcaacctctgtctcccaggttcaagcaattctccttcctcagcctcccaagtagctgggattacaagcatgcagcaccacacctggctaatttttgtgtttttaatagagacggcccgaagtgctaggattacaggcatgagccaccgcggccagccataactctgtgactcttgttacaaaggccttatattttgctctttgagggtggttttggtttgatgcctgttggttgccatcttttaactagggatgttttatcaaaatgcccagccaaagtgtccaaacaaattataccttaaagtttgaaaatgtctggcacttctaattcaatgcctgttgtgccaggcactgggctgctgaggaactgagtcccgtccctgcaggctagctagagaacacacacacacacacacacacacacacacacagagtggtcttacaagtcagttttatattctacctatatgcaataaaggtattattatgttgaggtgccttgatataaaaatttttcttaaaggagaggatgcctaaaacaggcattacctgaaacctcctctctccagcattggttgtcttctgtcatgactcagggttttcactgagaatgggatggaaatgtggtctaaagatagggccaatgttgggactggatcccctctgggaagtcagaccaggctagggcaggtccttgaagccatcaggaaaagcctctggagccagaaacaaaacaaaaaaaaaatggtgttaactaaactcagtctcaaatcctgaataggactcaagtcaagcaaaataattaaaggagttagcaaagggcaagtcagagagaccgagcaacaccaatgtcttccgggagccctgtggcgagtgacagagcctggactctggagtagaactcatcttgtgtcttcttctgccactcgttagctgggtgaccttgagccaagccccttaacctcttggaccctatgttcttatctctaagtaggggctggtaatatcttcccctttgaggaatgccctctaaggggtgttgtgaagattcggtaaggtggcaggggtaggactcctggccagaaacaggcacataataaatgctaagtctctccttctctccacctgctggatgctgtagatactaaggatttcgatgtgaatgagacaaaacccctgccttccaggagcctttgagaatcagagaactagacccatttccagaacaaggggatgcagggtctggataaagttttggggatcaatagagcagagggctcccagaggatcccatagggttgactcctaactcaagggcatgagacaacccccaggaagggcaccctggaaggggtccggctgtccctgatttacttgtgggcactgggggaatgcccggagccatccagccctcagggctctgtgtgattctgggttcctcccataaaagataatcagattctttcacgttaatgtctttctccacctcattgcacatcatgcagctattcattgactcagcaagtatcagctttgcatgcgaccttggcctacccactttagcttttagtaatagctcccttcttgaataatacaaccagtggggaaacagaacctaactcttacctctgggaggcttatttgctttgagaacatatgtcctgcagttttgttcatatggcagtgaagtttcgtgcacacactctagagccaggcagcctgggttcaaagcgcagctctgccaggtcctaactgcatgaatttgggcaagtcgctcaacctctccatgcctgagtttcctcatctgtaagattggagcaatggtaatacctgctttttagggttgagaagagaattaaatgaattaagatgggtaaagtgcttagagtggagctttgcaagtagtaagtgctatgtaagtgttcgatttaaaatgaaagacccttaaatacattctttgttcatttcacaagcccttcatttcacaaccttacatttcacaaccaagctctgtctcccctggaatccagccataactctgctcacaagtgtgagacaggccccagcagagctgcacgaagaggagagaaggcagccccccagactcccaaccccctgtccaagatggcaaaaccagaacacagcctctgtaccaccccagcaggtattcagaatctgcaatctccaaagcccacttcaattgtaaatgtagagccacgtgcgctttaagtcacctgtcactctggaggctcttttgctcagttcctcaccattagcagggatgacagggagtgcaggagtgcggtcgactcccagatattggagagcgctgggctagctgcccattctcccggcctccactcctctttgctgtccagccatcacttgctctttgaaggcaaacaaaacagaaaacagtgccaaaagtatgggaagaaagccagcttctcccctggggtgcctgtgatgccatgcccaccctccctgaccacgcagcccctgtggaccctcagggccccaagcccccatttccatcacatgcgtacacccatgtgtgtccatagccgcccatctcagtcaataaggctgctcctgcccacttggaatagtggtgacaaccaggagtggcttatgggaactatcccaatggcctgacagcatgtccgctgcaaaccgctgaggtaggacactgccctcatgtctagctgatcagcaagaggcgcagttgctttcttaggtaacattgctgctgtgtcctggccattgctggggggtggcacttaatctacaccagatttttccctcctgtatcttccaagctgcttggatcttggtgctgaattaggttggactttgtcttgtggggaagggaggactatagaccctcaacgtaagcaatggtcagactattctaagaaaactcgccgaattaaagcatgaggtaaatttagttctgacttctgtccaccccactgccactgtccccttttatcccatgatcccttgcttttcttttcctcctctctccctatctcttgtgtttgacgcatgataggaattcagaaatatatgtttgtggatttgtttattcacgtagcaaaccatttcttgagtgcctaccatgggccaggtagaatgggcggccccgggctgcagtggtttcttcagcccctctccagggtttacactgtgcaagacggtttgtgatgggtcctcccatcgaggaccacactcttctttctctgtgccccttggtcctcagtctctgaccccacttcaaaggcagcattcactcagggaagctcccatacaatgctagtcagagtaaaagtttggacaaattgccaggaagcagcttgtcagtatgcataaacagcctttaaaatattactactctttgacccagaatttcacttctaggaatctgtcctaaggaagtagtcacatgcaaaagatttatgtaccaagatgttcatcaaagtgttgttttataacaggaagtctcagaagctggataaatatccaacctctggaaatggttagatagaatagtatgtagccattagaaaattatgtctatggggtttaaaatgtcatgggaaaacacttctgacataaaagagcatgagaactgtatatttagcataatcttaactatgttttagaatgcacaggaaaaaaatgtacaaacatattcatagtgatgtctctggtggtaggattatgatcagtaagtacttctgtctcttcatattttcctgtatttgataatacatgcatatgttgtttttaaaataagaaaaattttaagtttaaaattggagctgaaaagtgtttttaggtcaggcgaggtggctcacacctgtaatagcaccactttgggaggctgaggcagtcagatcacttgagcccaggagttcgagaccagcctggccaacatggtgaaaccccatctctactaaaaataaaaaaattagccatgtgtggtggcacacatctgtaatcccagctacttgggaggctgaggcatgagaattgcttgaacccaggaggtggaggttgcagtgagccaagatcgtgccactgcactctagtctgggcaacagagtaagactctatgtcaaagaaaaaaaaaaaagaaaagcctttttaaacagtagcagacataactatataatccttactaagctgtcggtcaaatttttatttatatatttattttattcatttattatttttagacagggtctcactctgttgcccaggctggagtacagtggcgtgatcatggctctcttcaaacttgacctcccgggctcaagtgatcctcccatcttagcctcccaagtagatgggaccacaggtgcataccaccacacctggctaattttttttattttttatttttagagatggtgtttactatgttgcccaggctagtctcaaactcctgggctcaagctatcctcccacctcggcctcccgaagtgctggggttaccagcatgagccactgtacccagccctcaaatttttaaaaatctataagagacattattggacaattagagaaattcacatatggacttataatagtatcagagtgtgtggtgtgatggttctggagggaatggactttttctttggagacaggcttttctatgcccacccttttatcttgctaacttatcatcatccaggttccagcagaaacattacttcccccaggaaatttcttaagggtgcagtatcatgatgtctgcagcaaattctcaaatagctcaggaaaaaagtacgtgtgtggtatgagtgtgtgtatgtatgtgtgtatatatatacacatatatacacatatatatacatatatgtgtatatatatacatatatgtgtatatatatacacacacatacacatatatatacacacacacatacatacatgtatttttatataattatatatgcagagagtgcaaatgttgccaagttaaagattggtgagtctaggtgaagggaatatggtatttattgtattatttgtgcaacttttcttaagtttgaaaattttcaaaacaaaaaattggaggaagaaggcatgccagtctaccccaagccctccattggaatgctgaaaatctaaacaatgtgatttggcaatttcatttcttttctgttgtgggccagtagtccttagatgttggggaagggggtagtcgctgaggtgtggttgacttaggatggaagaagcagaagtcaagactcccagggtcaaagtggtttgctctgctgacccaagtgtgggaggcccagagtcagcgtttcaggtgtgctaattcagcatggttctattcacggccaaagtccaccctgggcacctctctggcagcaatcttgggtgactctactaaggccaggcctccatgaccctatgtctggatcccatatctccacctctcccactgtctcaggaacggtgcttagctttttcttttccctctcctgtcttctttgccagcatgtagaaagtttaaataattcccctctttacaacaaaacaaaacatacccccttcagtcaaccaccctagctctcttctccttttcccagccagatttttttaaaagcatcctaggccaggcgcggtgactcacgcctgtaattccagcactttgggaggccaaggtgggtggatcacaaggtcaggagatcgagaccatcctggctaacatggtgaaaccccatctctactaaaaatacaaaaaagtagccgggagtggtggcaggtgcctgtagtcccagctactcgggaggctgaggcaggagaatggcgtgaacctggtaggcggaggttgcagtgagccgagatggcgccactgcactccagcctgggtgacagagtgagactccgtctcaggaaaaaaaaaaaaaaaaaaaaaaaaagcatcctcagcactttggcaactccatctcctcccaacatgtccctgttactggaatccagccaggactcagccccgatctttctactctaaccagttgtctcagttaacaaggacaggtttatgctgcagtgacaaacaagatcccaaattcttgtggcttcacacatctggcaccacctcatcttccagccttaggagtcatcttttagttccttgaaaactctttacagttttctgttggggccttgtcatatactattcccctggaatgttctttcctatcccctccctttcaccttgctaacttgtgcccatccttcaggtctcagcagaaacatcacttccttggggaagttttctccaacacccacactacacaggtgtcccatctacactcctatgactttgtggtacttgtctcacttcattttccactgccttccccacaaggcacctgcacaagggcaaggaccgtaccactgtacctatgtcactcattgctgtggtcacctgcactctggctgcctaccttaactacacattagaatcacctgaggagcttttaaagccacaatgcaagactccaccctaggccaattggatccaaatccctggggtagggccagacatcagtggagttatatatacatatatatattttgtttgtttgtttgtttgttttttgagacagagttttgctctgtcacccaggctggagtgcagtggcgcgatcttggctcactgcaagctccgcctctcgggttcacaccattctcctgcctcagcctcctgagtggctggaactacaagtgctcgccaccacgcccagctaatttttttgtgtttttagtagagatggggtttcaccgtgttagccaggatggtctcgatctcctgacctcatgatctgcctgcctcatcagcctcccagagtgctgggattacaggcatgagccactgcacccggccatcagtggatatatttttaaagcactgcagagaattctgttgcatcagcttgagaaccactgatctgccttgtgcttcacatttaaaacttttttttaatgaataaataaaccccaaaaaattaatctccctaagcctccctagaagataggatggtaaggatattttcctaggtaaaaatatgttaatttcatatttcatgaaatttcatgtttcatttcaatcaagctctgtcatacaccttacatggggcaagcccagtgcctgggcagggtgtaattatactcattacacaggcaaggaaaagtcacattaggtgatggagcacaaataggcagttaatggtttcagggctagttaggatatgtttgtctttcaattgcaagtaatagaagcccaaagaaattggttatttatataatataattgattggttcccaaatttgaaaaattcaggaatagacccagcttaggtacagctggatccagtcactcaaacaatgtcacaaagaaccctttgacaggaatgtatcctgtgttgactctactttgctctgagtagtctttccccaggtgatgataaaaatggtcatcatcgccaggcttgtgtcctgtttagtaggaatatacaagaagagctcagtaaatgctggccccaccactaagcaaaaacaaaacttttgttgttgttattgttgttttaaataacagcttagacctttcttctttccttgttattctctttcatctgtaatccagttttctacttctgaagtatagaatgttctgatgatttattcttcattacccacaacttgcacatgtttatttaaaaatgccaggattgcctggccgttgtgtgctgttaacctttgtttgctgttagtggatccctgaagttcaggctcccaggggagcagataatgggtatccagttcctgcaatatccaccctctggcaagccaagttccttcctgggtaaggttttgcctacctgcattcctagggaagtttctgggcctgaccaccaagccagctctgagaaggggtgcataagccccaccatgctttggctctgtccctatagaatattttatgttgttactgaaaactaaaggaagatgggtgcggtggctcatgcctgtaatcccagcactttgggaggccaagacagattgatcactcgatgccaggagttcaagaccagcctggccaacatggtgaaaccttgtctctacaaaaacaaaacaaaacaaaaattagccgggtatggtggcatgcacctgtggtaccagctactcaagaggctgaggcacaagaatctcttgaacctgggaggtagaggttgcagtgagccgagatcgcactactgcattccagcctgggtgacagagcaagattctgtctccaaaaaaaaaaaaaaaaagaaaaggaaagctaaaggagagagactaaaatgatatcaggttcctggagaacaaacagacatgattttgcttcatggcaggacagccggaagaagtgggattatatcctcacattacaaataagaaaactgagactcagaatggttaagtcacttgtcccaggccacacagccagtaaattacagaaacagaatttgaacccaaatcttccagctccaaagcttgtgttcttttcactacctcctgcttaattttttaatttctaagattagacccttcatctatccatgacacctgcctgtcatcccctgaaaaaaggtgaacgccgttcagaaatttttctagcctgagctcactcccagttcacttatttttgctttgtcatggctgcccagtccccacttgtagaccaggaataggtcatggctgcggggactacacgctgtcgctgctgcaagggccggcctctgtttccggggctgagtgggggccagacctgccaggagcaccatcttctgtgggtcctgcctggatgtcacatcccggccccaagaagtcactgcaaaccttcgtattattgagcttcacatcctagaatttgctgtcactgtggctgctgcatgaagttgtcctgagagaaacgggcattgtcattaacagggaaattgatggtctgggggaaaagtcatcctcattctcttgcagatctatgggtgattgagactggctgatgttgaaggggtttctcagccatcgtgtgccatgttatggaacagtggtgtagccagccatttgacacccagcgctgacctttgtttaacaacctcacctatatatgacaaaatgattgtcagaaataatcgtgtaatgaaatgactgtaataatggccagaaaagaaacgcagatagtaaaatgtttctcttgttgaactctgtacatataattgcaccaggatttttttcaaataaaaagtaaatattatactacaaaaaagggaaaaagcacaagcatttattaaatagctttctatatctttctgagttttgatcctttgattgcagactgatgtaatattttatgtaaatcattgcttggttactaagtgaactttaagaaaagtgagacgtctgcagaagttgcccataatttagcagctactgtattgtaccattgatgtacggctttattttcttgattaattatttaaacaatataattcacaattttaaaataataaatttccacttaaaatggtatttaaactcagcaaaatatatcatctatgagtaaaatttgtatttaccaagcaaaaatattacagtttgtggttcacatgctgtctcactgttttaaattttaaatacaaaaactccaagtaggctgggtgtggtggctcacacctgtaatcccagtactttgggaggctgaggcaggcatatcgcttgagttcaggagttcaagatttgcctgggcaacatagtgagatcctgtctctactgaaaacaattagctgggtgtggtggcacatgcctgcggtcccagctactcaggaggctgagataggaggatcacttgaaccctgggggacagaggttgcagtgaggcaagattgcaccactgcactccagcctgggtgacagattgagaccctgtctcaaaaaaagaaaaaaaaaaaagaaacacaaaaactccaggtggtcgcacagaatgacaggactgaagtaacttagctccaatttctgtcttcataatcactgtcctaccattgtctgtgcttagaatctacttgcttaatgcaggaacatgtgttctcacagagatggaaaatgcaaatggcgccagaagcaagctggaaattctgaaccattaagaatttactctctgccaggcacggtggctcacgcctgtaatcccaggactttgggaggctgaggcaggcagatcatctgaggtcaggagttcaagaccagcctggccaacatggtgaaacttcatctctacaaaaatacaaaaattagccaggcatgatggtgggtgcctgtaatcccagctactcgggaggctgaggcaggagaatcgcttgcacctgagaggtggaggttgcagtgagccgagatctatctgcaccattgcacttcagcctgggagacagagtaagactccatctcaaaaaaaaaaaaaaaaaaaaagaacttactctcaaaataaatacgtgtggctgactccacatatggtagggccaactgtataactagaagttctccaaataacttctgtggagaaaaaaaagtttattaaaggttaacttttttaaagtgctaactagaaccttactaacactgagatcgcaccaattgtttataacttagacagggccgggtgcagtggctcatgcctataatcccaacactttgggaggccgaggcaggtggatcacttgatgtcaggagttcgagaccagcctaaccaacatgatgaaaccccatctctactaaaaatacaaaaattagccaggcacggtggtacacgcctgtaatcccagctactggggagggtgaggcaggagaatctcttgaacccaggaggcggagattgcagtgggccaagatcgcaccattgcactctagccccagcaacaagagtgaaactctgtttcaaacaaacaaacaaaaaaaaaaacctcttggaccaggaaaatattttttaagggaggagtattttatcactggcattgtttaggattgcaggcacatgatgctaatgaaaagcagactaactattagttggttttattactgtttttgaactctctctctcccttttttttttttttgagacagagtctctctctctgtcacccaggctggaatgcagtgactgcagtctcagctcactacatcctctgcctcctcagttcaagtgattctcgtgcctcagcctcccgagtagctgggattacagggcaccacaccaggctaagtttttgtatttttagtagaggcagggtttcaccatgttgcccaggctggtctcaaactcctggcctcaagcgatctgcccatcttgacctcccaaagtgttgggattacaggcgtgagccaccgtgcctagccctgtttttgaactctctagagacagtccagccccttattacttgtcctgaggcagctgctcccttcacctggccccccgcattgtgttccggacccttgtcctggtggtgctaaagaatatctctgtcgatcctttggggactggggaaactgaggcccagtgccacgcgatgccatttgttcagggaagattaggtcatctgctaggtccccagtcacttgaccttcttcccagacaggaagaagctgctctgggtctctcagtgctccacgtgtctttgcacattgaaatgttttctgatttttttttttttttttttgctgttacatttacttttaaaaaataacaagcaataaaatgttacatttgagaaggttgaaatgagaattgatttgagttaaattctagcagatttttcttagaagaatgatatcatcatctccagctacctgcaattgatctactctgaattaagaaagagacttccatttgttgtttatattttgcactcttgatgtgtttctttaaattatggtcatgggccaggtgtaggagctcacacctgtaatcccagcaccttgggactctgaggagggaggatcactggaggccaggagttcaagacctcgtctgtacagtaaattttaaaaattagccaggcatggtagcattcacctgtagtcttagctacttgggaggctgagatgggaggattgcttgagccagaactttgaggctacagtgagttattttcacgccactgccctctagcctggctgacagagcaagacctgcctcaaaaaaataagtaaaaaataaattaaatttcaatcattagcagtcattaggatatttaaatacagtatgttgaatcaaagttacgcatgtgtgtatttttttttccagagagttgtttatcatgtgggttttaatttaactttaaaaaaatgttggctggacagttgcccaaatggtatcatcagccatttggttgagaacgtatgtcctgcgggctcctctgtcactggagttttgctagctgacagccactggctagttagagactgcagtcagcacagatgcaggcgtggacttgcgcacgtaaccatgtcaatgcaaagccatcacttcttaaaaattctgaaccctgctgtctgagatggtggtgcagcggatagaactctgctctaagaggcagtagctaattccatgtcttctttgcccttgactagctgagtgactttgcacatggggcttgcctctctgttgccttgtctgcaaagtggaatcatcttttccttgctagacagaaggtggaccctggacctatggcctttttgagtttcccccccgcttcttagaaggacctctgatcctactgagtttaatacccacgggttaataattgggaaaagcaaaggaagcgcttctgtttaggtaattatatgcatgtttttgtctttttctggctggaaagatatccaagccactgggaaggtccgtggctacccagggtagccctctctggggagggctgctatatccaagagcccctcatgagaatttgaaaatcgaccatggtagggcctgctgacttttgacagctaatggtgtgctgagaattgtccctccaaagatgcctttccattccctcgggagagtctgggcagcccctactgggggctgggatgctggctcttccctcagcctccaccccaactgctctcttccctcctcccctccccagccccctaatttctctcacaaggctttgttctgcagcaacctttcctaatgcagtcctggcctcttcgcagcttcattacataaccttccgtggactcctggtccaaggatcaccccagaaagccagtcagaggtaggcacgcagctggggtccatttacttaccttccccaccccctcggaactcagaggtggtgcaggaatttggactccaagaattaacagctccaccaccatcaccagagccaaaactcaggatgcatgtgcttcatctgctgcttatttccagctgagagccagtggtgccatggttccttagggagccggtcccctgatgccggctcctggccccaaatctctctgatccgggctcttccagaatgtcttgtctccaccatcgcctttgaccaatggtgtccctttgcctggtaatgtcccctttgcctgatgatggccctgtcactcctctctttagcacagaggaggctgtttcatcccttcaagcctgccctcccttcaagtcttagctcaagttcaccttctccgcagagccttctccaatcttcttgactacgtctcctctcagctccagcaacctctgtctctggcactgattccttacttagctaagagaatcacagacacttggggctcaggacaatctgctttctctcttcttacccatggccttggactgtgtgtacctctttgtctccactcccaaacccaacccccagagggcagagagcatgttgtctgtccctttgctcagcatgaagccatgcgtgtggtagatcggcagagttccataacttgtgttgaccgaggggtcactttgctctgaaattacccctgtgtccttcagtatttgcacagatagcttcctggccagaccgaatatatccaagggcatggcccacctctgctcctgtttccaggtccctggtgggggttagttcatgccttcctcataatctgcccactggcctggtcctcaaggtcttcccaactgctcagccagagttgagaaaatgggtcgctccatcctgtttgtgtcgttctctccttcctggcccactctcctgcccacaggtatccaggggctgcctgtagcattagaggacatacatgcacatgcgtgggcatgggacactcacgtagcctccaagcacagcatcaataatgcattctgtgctttatagcatggaaagctgctctaaactttattacacagtggacatgtctgaagcagctcccaaatccacccctgagtgtgttggaattggcaagcctatcacttgggagtctagtttttttgttcgttaataatagatgcttcctgtggccccagcttggcaattttgatttaaagtgatcttaactgaagagactaatggacgggtctgaatttgtgccttttaagcacaaagtattgctcttaattaactggattctatcctttgagcaggcagaggccttcccccaagggcgtcattaacgatccacatctggacatcttccaaagccttcttctgtttcaggccaaccgcaggtgtgttcctgaacacccaggaggctatgagagccacatatgcctcccaaatacacacagtgtgcatgcccagggacatagagcagtgtgcaaagtcccattccatctctctccacctgggagaggatggctcttctgtctgattcatggctcaaagtggtaaaggagctccccactccccgtcccacgcctactcagagtctgcaaatatgtatgcgatatgagagctcgtcagttagctgtcttcagtgtggcgcacatttgaggagtctgactcccctccagcacaggccaatgtgcactgctctcctatctttgtacccccactgttgcactgtgcagaggttggagccatagaagtaccagagctgtgaaaggagaggccccctctcacctctgccctggtctccatccccactttctctaggaagctagtaggtgctgacaggggagagaagggaggggaggggtccagaaacagtggctcatgcctgcaatcctagcactttgggaggctgaggcaggaggatcatttgaggtcaggagtttgagaccagcctgggcaatgtagcaagaccctatctctacaaaaagaaaaaatgtaattagctgggtgtggtggtgggcacctgtagtcctagctacttgggaggatgaggtgggaggattgcttgagcccaagagtttgaggttacagtaagctgtgattgcaccactgcactccagcctgggcaacagagctgagaccctatctcaaaaaaagaaaaaaaaaaagaaaggagagagagagaaagaaaagaaaagaaaaaaaaaaaagaagggaagggaaagcccagaagagtgtggggagaggaggcggccgtcattctggggccctcagtgtgcacaaccagataacacatgctctgtgggcttttgtaccattttgcttgagcataaagaaaggaaggctgcccctaaatagaaagcactctggaggcaaacaaatctgactccaatcctggccctgccactttcccagctgaggacttagacaagcaccctagcctcttggacattctcagagccatctgctgcaagtgggtgctgccatacccaccttactgggcaggcttgggggaccaagggtggtaaatggctcagtctttcatgatgcggccacacagcaggtgcgccatccaggtccatttctttccttcctttcccccaaatcaagttgtcattaaagtactagtccacattaatgaaatcaactgtattaattttctatttgctgctataataaatcatcagaaatttagtggcttaaaccaacacaaatgtattaccttacagttctggaggccagaagccctccataggtgtcactgggctgaaatcaaggttttggcaaggttgcggtcctttctggagggtccaggggagaatccattttcttcctttttccagcttctaaaggtttcatgcattccttggctcatgatcttctatagctatagtcagaaaaattttccatcaatcatcttcaaagccagcaatggcaggatgagtcctcacatcaccttgctctgacaccagttctctgcctccctcttccacatgtcaggaccctcatgattactttgggctcactctgataatctgggatgatctctctattttagagtcagctgactgggaaccttaattccatctacaaccccaattcctctttgccatgtacagtgacatattcacaggttctggggattaggacgagcctgtctctgaaaggctactttacatgaaaattcatttttttaattaagatttttttttcctcttgagacaaggtctcactctatggttcaggctggagtgcagtggtatgatcacagctcactgcagcctcgacgtctctgggctcaggtgatcctcccacctcagcttccctagtagctggaactacaggggtgagcccccatgcccagctaatttttttttttttttttttttgagacagagtctcactcagtcacccaggctggtgtgcagtggtgcaatctcagctcacagcaacctccgcctcctgggttcaagtgattcttgtgcctcagcctcccaaggagctgggactacaggtgtgcaccaccacgcccgactaatttttgtatttttagtaaagatggggtttcaccatgttggccaggctggtctcaaactcctgatctcaagtgatccaccaacctcagcctctcaaagtgctgggattacaggtgtaagccaacatgcccggccccagctaatttttaaatattttttttgtagagatggggttttaccattttgtctaggctggtcttgaactcctgggctcaagcaaacctcccaccttggtctcccaaagtgctgggattacagcatgagccactgcactcggccttaagagaagatttaataattaatactttacaacaagatctggaagaggtgggatgagtaactaaatgaggatacaagtaacccgggtcatatttgctaatacccttggtcacattgaacttgatatcttatcagattttcctaatcagctcctttagcagcagtgttgcagcatcttatctcattttgttttttgtttttttgcctagcacatgcctgtaaatcactggattgaggtgtttagatgtttgttgtcctttggatgcttcttataaatccatatttcatggctccctggaaagtgctatgcaaatgataagctgcaaggatggaaaggaaattgcagtgctcctgaattgtaaatgggcttttacgaggaggtttctaattactcgctctttctcttgaactgaggagttgaagtgtaggtggcagatccataacagataatcatgtgtgtgatgtgacttcagcctgagcgtcgaggaccaagtcacagagcaggaacagccactctccagtgtccttggggctacgtctgaggagaacctgggatttcatatatgacctgcactggctggggggctctcttgacgtaacgtgttccctctgagcatgttacagattctgacattcttatgttccttctgtggagagacatgtacttagtgacctaactcactttagcatatttttgctcatcgtttgtgtagcttaaaggaatcagataattaccccctccccactactttcggaagcacaaatgcaatgccctagaattgtactggggactcaaaaagaaaagagagtagtaaaatctattaaaggggacaaagacagcctatatactacaagctttctatttttatggcagagaatgccattttctaagtaaacagagaactgcatttgacctgcaatatcaaatgcatggatttgatgctttggaaagcaactgttttctgcgttaatctgggtgtcttccgtgaaatgtcctcctgcctttggcttaaacactagctttgtctacagccattccatcctgaacctgcccaatcttgtctgaatcctggtttcaccactgacaagctgtgtgtccttgggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccaggtaaggaatagttggaggagttgggcatgttcagcttgaagaggagacgacaggggatatgggatagttgaatctgtgaagggccccctgggatgaagaactggcatgttctgtgtggctccagggcactgagcaggacccatttgccaaagtctcagggacacagtttctagctatagacagaaaaattttctgtcactcagaggatgaaaatagaatgagcccccttaagaggtaatgagctccctgtcattggaaggattccagaagagctaggtaaccactttaggtgctatcaaggggcttttttctttaaagtcctttccaaaagcttctgagattgcataaacaataggaagccatcttggtgctttaacacaaactctccccagtgatgagggttgagccaaagccagattggcaagcagagaggagacttgtgtacaaggagttcctcgagtcaattgctttttccttgttctagccagccagagggctcctgttggaaaacaggagaccggagaggctgaggcctgaccaaaccagcttctgcaggccagctgggaggccacaactcctacctacgggaaaactgaagggcatctctatttttagattagcaaaagaaaataaatttaagtttgagtctcctttgcaacttttaaaagacatctttattgagatgatcattcacattctataaaattcccccactttgagttacaattcagtggttttagtcttccttgatgattttgatggtcttttcttaaggctcttggaagacccagaagcctctcagacacaggtgggtgtggagggcgtagcacagaggcagacttctcatttcctgggtctcccctttaatgactctcagagacccctccttccccctgcccctggcttctaccccaggggtgtagagttttgccattttccaagcagaacttcatttcctcttctgtgtctacactctttgtgcttctttcttgccagctttttctcctttgcccgcccttccttccttccttccctccctccctccttccctccttccctctttccctccttccccccttccacccttccccccttccccccttccctccttccttccttccctccttccttccttccttcctgccttccttccttcctgccttccttccttcctgccttccttccttccttccttccttccttccttccttcctggtatgtgactaatttctgtttcaggacataaatgttgtccaggctgttctttggtctttctgttggataatggacatttggcattgagagaggctgctttttctgaaatcatgttcttggggcccagaacctaggtgtgtgcttctgactttgttttcttcctgatccaaattctgatatgtccatttaaattgatctagacccacagggcactgtgggacagatcctcagtggaacatgactctgtaacgagagcattttgttttgtcaaaatgagaacatattattgcctttcatctgattgtaaacataatacatgtttataaaacagtataatgagacaaaaatgtagacactaataagggaaaatctccctaattgtatttctcttcacagagaaagcccctgttgggcatatatactctagtttgtttatttgtttgactacacatatatgtattcttttcttatgtataaaaattctgaacatgcacatttctgcaactactgttttcacttgatgatgcatggacctctctagagtgtacgtttcttcttccttacaaagcagttggcttcgcccagggtacaccaggacacggttttggctctgtccccagggtgtcacgggaccaggggatgatctcacagggtctgccatctgccctgcctggccggaggctgcatcgagagggccaaggggcaccacgtgtcgtgggtactgtcaaacaagagccttcagagccttccacagtctttcttttgcttcccagcattgcttccccgctggtggactctgaatctagaactagctccaggcgcctctccaaattcagacgggagctggggcactattataatgcaaatctaggcaaagccctcccaataccaggatccagaatggggtggggccctttgccctgaaaagctgtttagtttgaaaatacaaacaggagacagaaaagtttggctaaattaatggataaagttttaacgatggtaaccatagtagggttcatcgacagccagcgatggttctgaacacttgacatgtattaactcacctaatccccacattttacagacaatgcaaaggaggctctgggaggttgagtgacttgccccaaagtcgcacagctcctaagtgaaggattcggagtggactccaggcagcctggtctgactccctgcactgcgctgtgcttatctctggccccaatgccgccatgcagaagtgtctgggggcactttgtctctgtcagacagaattcggagatgtgtatgcttgccctggtatggcacttctctttttttgagacagaatctcactctgtcaccctggctggagtgcagtggcatgatctcagctcactgcaacctccgcctcccaggttcaagcaattcttgtgcctcagcctcccaagtagctgggattatagatgtgcaccatcgtgcctagctaaatttttgtacttttagtaaagatgttgttttgctgtgttggccaagctgatctcgaacttttggcctcaagtgatctgcctacctcagcctcccaaagtgctgggattacaggcatgagccaccatgcctggcagtgtggcacttcttacgtgtgttcagcggacactgtttatcttctgtccctccaagacggtgctgagctcaggtcgttcattactggcagacaactgctgatttccaacagaattgccatcctcttctcccctgcgactttcagagtgtgacctcagactcaaaaattagaagtgaaaacatcttaaaaactatcaccttttcttcctaatcctcctctcccctccctgtcttccttgttgtccccatctaatgaactatcatggcaaaaagagcccatttctggtcattttctgtggcctttcaaactcccacctaccccactgctcctgggtgcattacccgaaagctgagacttcagtgcagaaagtgccaggccctctgtccccccagatcgccttccttgtcttccctgtgcttgcctgtcacattgtgtgggttccagcgctggaaggaatgaggaacagattctctggttctccttttgaagtttaccttcgctccaccacttctgagaccttcccggaagttgccccttgtttctctcctctccagggctgccccagagctgcctctcacctcttcctgctgtcaccccaccaccatcagggcagaagttgggacaaagcctctcctactggctcctgcttttctcccttaggtccagcctcctcttctccatcttcaggagtctccttctccactcacacgtcatgacttcagcacctcgcatcagtccagaatatgactgcttgttcaagtgccacctttctcatgcatttttttctagtgacaatcacagccaccctgtggggcaggagtgtcatcatccccatgtttcaaatgaagaattgcagttcagagagggcaagtgactggcccagcctcaacagctagccagtggaccccaccagggcttctgactccagtccgggttccctttccacccaaatccatggagggagctgagccgagaacaggtgtccttcaggaagacgtgaagccaaagcctccacctccaaactcaggggcccagggagtccaggcacccatccactcacaaggctggatatggtgcattccaggagaggggttgggggcgagtggcctctctgtgtacccgtggggatagatgcgcaagtggcatcgccacatcgtgagtcctggcttcatgggtgagctccaggtccaacgagaagccaagcagggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagtgacccaagggtgcctctgagaggcctcgcagcacccggaggtgctgctgaggcaacgccctgactgtaagaaggaccattcatcctcagagagtggccgtgatgctgctgcgacagtcccaccatccctcccgactctcactcccaacagacttcccactgtaaagctgaactctccagcaaatcacctctcgccagactctctcctcactctctctgggtccactagaggttcctcagcctctctttgccttggttttcccagctgtaaaatggagcaaagagggcctatgtacccacaaaggtgtggttggagcgactcctcctacattagggcctcgagtggggcttcatgattggttggtggaggtctccaaacccacccagtgccaccgaaggctgagactgcagatgcaatgccacaggtgtccttcctcagcctgggcagctgaacatcatgtgtaaaacggggataataagataataacagccccttgcacctatgtggctgtgaggattaaacaagataaatgtgtaacagtgcctggctatagaaatatttactcttgttattaagggaagaatatgtgtggctaaaaagggatcgaagatgtaaaagccaatccctccccctctagcatatttaagggtaatgttgagttggtttgtggaccatttgctgcctgttagagctggaaggtagggaccccctctcaacagcgatgctacaaattatacccattggaggtcaaccaaaagacaaagcttattggctggacatggtggctcacacctgtaatcctagcactttgggaggccaaggcaggcggatcacttgagatcaggagttcgagaccagcctggccaacatggtgaaaccccatccctactaaaaatacaaaaattagctgggcgtggtggtgcacacctgtaatcccagctactcaggaggctgaggcaggagaatcactagaacccaggaggtgaaggttgcagtgagccgagatcgcaccactgtactcaaaccgaggcaacagagggagacgcaatctcaaaaaaaagaaaaaaagacaaagcttgttaataccagcatattgttaagggaataaagtaggctgcagaacaactggtgtaatatggtgccatgtagggaaaattacatgtgtgcataggagaggggtctgcaaggttgtgccctaagatgttagagtggttcctttgcttttctcttttataattttgtatttgacttttaaataaggaccataaatcacttttataaaatacattctctccagcccctactactcctttaaagaataagagtggtttgcccaagaaagacagttttttttgctctggttttcttgattctgacatcagaggaaactccttctcatccacttggggctctgggttcaggggattcatttcaggcagattaaagtggtgaccaggggcattcgtggacacagggagggacaggagcaccatcagtttgtctcacacaaccactgtcatcctcactgaaggctgttgcctgatcaaaaacagtattgggccaggcacggtggctcacacctgtaataccaccactttgggaggctgaggtgagtggatcacttgaggtcaggagttcgagatcaacctggccaacatggtgaaaccttgtctctactaaaagttcaaaaattagccaggcgtggtgggtgcctgtagtcccagctacttgggaggctgaggcaggagaattgcttgaacccgagaggtagaggttgcagtgagccgagatggcaccaccacactccagcctgggcgaccgagggggactctgtcttaaaaaaaaaaaaaaaaaaaaaaaatatatatatatatatatgtcaaaaatggggtagtttttagatctatagtagttctaaaaacaaaggccatccaagcatgacagatttacaagcactattggctattccagtagttacaatggaggagagaagcttttagttaaaacaaacaaacaacacaacaaacccagaaaccttaggtcaaaaccaaaattgtcctctcagacacaatctgggaattttctcatgacagtgggcattagccaactgacatcagcagcaaccatccgtgtgcacacagtggcaccacctcctcccaaaaagcagccttcatctatgccctcatacaatcgttgattattctctttggattgaggcccggaattatttaagtttcttcttgccagcatgagtctttcctttctgtatgctccttatcttctctctttaatttggcagttctgcttgaaatctgggtctttcattagtagtagttcaatttggttccagaacattctgtggtgtgatgcaatgtgaccagagctcacacttcagagctcttcaagggccagtcttactgagcacctcccagtggctgcctgtgtgctgggcgccacttgtggtgggcaggagagaggaggggacacaaaaggagacacagctccttcttagaagctcaaagttggggaccagctgccacagaagagtatgtttagcatctgagacaccaagatccagcgtcacaagggtgtttattaagcctcctcatctctttctttttctttttttttttttttttcctcaggcagtcttactctgtcacccaggctggagtgcagtggcatgatctcggctcactgcatgcaaccaccacctcccgggtttaagcaattctcctgcctcagcctccccagtagctgggattacaggtgcccaccaccacacccagctaatttttgtgtttttagtagagacagggtttcaccatgttggtcaggctggtctcgaactcctgacctcagatgattcacccacctcggcctcccagtgtgctgggattacaggtgtgagccaccgcgcctggccttgctgttgattcatctatagtatgtttgacttgatgacctccagttaccttagacagaggttctcatctaagctccaactttccatttcctttgtcctcgtctttccccttaacccctccacatttctctcaaaatcaccccacttctaaaaaatactgtttatttttcttttaaatttcaaattatctatactcattgaaataaatcaaaatagcatggaataagcgaaaaaaatggatcccacccttccccactcccattccctagggctaaccatagttaaccatttaatgactaggtttttttgttgttgttattttttatttatttattttgagacagagtcttactctgtcacccaggctggagtgcagtggtgtgatctcggctcactgcaacctctgcctcccaggttcaagcattctcctgcctctgcctcctgagtagctgggattacaggtgcctgccaccacacctggctaatttttgtacttttggtagagacagggtttctcaatgttagccaggctggtctcgaactcctggcctcaagtgatctgcccaccttggccttccaaaatactgggattaaggtatgagccaccgcacccagccctcctgggctcttttcctttagttgcactcgctccccgctcctggagtagagggatttccgagagactgtgggctccagccttcacctaggcccaggactaggatgcctgccctaacatttatctttataccttaaagcaaaacagctggaccataagcattcaagaacaaactgtgaataaggagaaagttctcccaggaaacaagagctttagttatgttgggccagcccttatattccttagctgttaccagtcactgcttgatttaatctcggctatcacttggcctgacaggtctgctgctggtgccaggatgtctgggttttgaagcctggctccattacatacttcctgtgtgaccttgggcaacttactcaacctgtctgttcctcagtttccccagctgtattatgtcagcataatagtttgttgtgtgaattaaatgaggtaataactggaaatgcttcaaacatggttcctatcatgagaaatcctgctttccgcctaaatgtgctggaaaattcctggtggtgcagaacaggagaccagagcaaaggaaagacagggtgcagaagccaaaaattaccttggagaacaaagcgcatgttaaggttatttttggattctaggtttatctctgcttggtcttcagttacctacaagagatccatttaggggatttttgtttgtttttaacgatagctttattgagatataattcatatgccataaaagtcactcttttaaaatgtttccggtatattcacaaggctgtgcagccttccctgtccttgattccagtctgagtttttaactgaagggataaggaggaccacgctttccccagaccagaaccgcgggccagggggcgattccgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgagcttcccctgagcccctggactcttgactccagcagggcctgggtaatgaacgtcagctcccctttcccaaaggggttgctctgttgggaaggcacccgtttgatacagtagcatagagatgggttttagcatcaaaatatcagaattcaagccttgctctctgcttactagctgtgtgaccctaaaaaggtttctgaacgtctctgagcttcagtttcctcatcattccttctcacggggtggttgtgagcattacagagatcctctctgtgaagcccctgtgagtggctcatcctgagggctgaaataaacatgttattaataatccaaaactggcaagggatgttgactggtccccctcccttgcccaaggagctttctagaacctgagttatcattaccaaactgtactgccttgagtaagaaagttagaaggaatgggaaggatggtggcaggtggaggaaggcggattggtcatcacctccttgcagcaagaaacagccccagatcgtgggaaacctacagacctgctagacagactaggagcaaaagctggggctttaagaatccccagggaggttctcctgagagagtagccagttggattttgtaagcagagatttgtttggggaggaggtgacaacgtagggagcagaggggcaaagctgtcgggaatcctgccttgagggcagggatgtgtgttggggggagttgggtcactggggctcggtggccttgggcaagtttctacctctcaggtcctttacccacctagggtcgccatcctgcccacctcacaggttacagtgagcctggatgcactgtcatgggcaggtgcccaggaaaatggcagacatgttccaaacagcacgcagcattccccagtgatgcccagggtcaccttggaggtgggcgagatgcctggggtttctcgtccaccccacaacacctcaggggacagccaaagctgtcccttcaggtaagctgcacagaagatgtgaactctgctgcaaagactctattctttgggagcaaaagggacccagggtctcacctgcacatccctgtccctgagggcctaggggttcttggaggccccagccttggcaaaatgaggaagaaggtgaaggttgtctgggcccctgccaggctccttcctcggccacgcactccccttcctgcacacacacccttctccctccaccccatctccattgttgtcagaaaagtcacaataaaaaggtccatattgtctagttcccatacttttaatttttaaaattttatttatttatttatttatgtattttttgagacagagtcttaacccaggctggagttcagtggcatgatctaggctcactgcaacctctccctcctgggttcaagtgattctcatgcctcagcctcccgagtagctgagattacagatatgtgccactatgcccagctaatttttgtatttttagtagagacggggtttcaccatgttggccaggctggtctcgaactcctggcctcaagtgatctgcctgcctgagcctccggaagtgctgggatttcaggtgtgagccaccgcactcggctccacacttttcacttattaaaagactgtggtgtccatcaatggatgaatgaataaaccaatgtggactatccctcccattacccaaggaatgaagcacggagccgtgccaagatctggattcacagtgaaagaagccagtcaccaaaagccacgtgctgtgtgacttcccttatacgaaatatccagaagagatacatccatggtgacagaaagtagatgagcagctggggactggcgaaggggagaagggggagcagctgtctatgaggtccagcctttcttctgggtttggtgagaatgttttggaactagatagaggtgatagttgtacaacattgtgaatgtactaaatgccactgaatcattcattttaaatcgttctttacgttgcatgaattttaagtcaatcaaaaacagttgtttgaaaagagaaaagcctatgggtagcggcagcagtgattggatttatgattcgattccatggctcatccctcccctgcctcaccccctcgccctccgacgtcttcttcttttactctgaactgttatctttgttctcatctctctctctctctctcaaccctgcagacacttttccctttctttgtctgcccccaccctccagatttccgtgtctccagtgtctccctacgaggcatgaattgagactgggagggtgtgattctgaagaaggcaccaacagtgactcagctagccccttcccccaccccgccccccgggcctcaatttagctaaaaaaccacagggacggactcaggaggcaatacctttccaagggtccctaaaaaatgtcccattttagtgtccaggtttcactcaactttagtgcctcccctaaaatgtgttccttacctcccaccccactgcatctaagtcactgcctgagaaaacaggattgaggaaaggagaaaggaagagagagagagaggaggagagagagagagagggaggaaggctgatggatttagaaaagaagaaaacaagtggtctgaggaaaacagccttggtgtgtttattttcctgtctgtgtatcgcttctcggccttttggctaagatcaagtgtattttcctgtctgtgtgtctcgcttagattacagggatctgtgggtgatgacacgtctggtccaggctgcgtagtcacctcaagggcatgcttattgatgtgtttttcaattcactatctttgcatgggagtcccaggccaagaggcacagctgcgccatttgtctgttggtttagatatcctttatccagttcttccagagaaatcatcctgcccttctggaggaggtgggcagcaggggtcagagatgggagggaaaggaaggagccaggtccttggctaggatgccagggtcccctgcctctcacctggcctgggctggaggcctcctgctgtcctgtcactgatcactaccccgccccagcctcctgagttagaagacacaggctaaagtagagtatttcttcattgaaaaacccatacaaaataaaggttcataaaaaataaaaatttagactgggtgctgtggctcacacctgtgatcccagcactttgggaggccaaggcaggtggatcgcttgagccctggggttcatgaccagcctgggcaacatagtgaaaccccatctctacaaaaaatacaaaaaattagccaggcatggtggtgcatacctgtggtcccagcttctcagcctatggacccacatagaatacaatgtcagcataagaagggagccctggggtcaccaaatggtttgggcggcaaagaacctgaaggttgagagaagtggcttggttacccagctgttggatgtgagacctggccactgcttcttccataccctagacctgcaccctgacatctcaagtaaaaagttgggggatgttttatggtccaggatgaaggaagggcagtgaggggcagcggagcatcactttgcatttctgtctgcctcttactggctgtgtgacctggggcaggtaacttcccagactcctgggaatcataacacctatgatgatgatgatgatgatgatgatgatgatgatgacacctacctcaaggattgccctgaagggtcacagagatgcctgcaaggcacctgcatggagcaagcgccccttctctggcaggtgctgggtgagcactacctgctgccaggccctggggctatggcactgcgtgaccctgcaagtcctacctggcgaagctgtcgttcttgtgctcagtcagtgttggttgtaagactgagaagagtcacttcattttgctctccagggacatctttctgggtcctattttctgcctatgtcaagtagcgcctcaaggatgctcctgaaaatgggcttgtctttcttaacatggcaggtaggtcccaaagcattagcatggggcagctgacctagcccagccaatgcagtgcagtgactcttgcaaccgagtctaatcagaaggtccatgaacctacgagcatttcctgtcccaggatcagggtggaggctgagcctccctgcttagagattcttcccatgcattccacttttttccccaaaagaaaatattgacccttgagaggcacacagtttatttattttgcatagtaaatagtagcctgtattttaaggatgagttgatttctgcatcagcccctgtaggtcatcagccttctattggtgcatctgactctctctagccctgcagggatggtggagggggaggggaaggagggatctttattggaaaccaggacagtgagactcattgccctgtcatctgctctgtggtgctgaatgaggcagcccaacagagaaataccctgagcgagcatccccagcctccaaaacagtggcgcattgccctgagtcctgggaatgacctttgattctcctgctcctgacttggaacccatggaaacctctagaagcagctgaggaaaacccaacatgaaaagcagaactccacactgagaatataggaggtgatcggaacatacaatgattcttgctaagaccgattcacagtttttcttttttttcgatcgaagaaatactggagaagcctaaagaaggagtctaaaaactctggcacgtgggccaaaactgtccttgagctaagaatgattttcacatttttaagtggttgaaaaatgaaataaaataagatgatgttttgtgacacatgaaagctatgggaaattcaaattctaatatctataaatagtgttttatcagaacacagtcatgctcatttatttatgctcgatggctgctttcccgctacaattacgttgagcagttacaacagagaccacgtggcccacaaagccttacaatatttactatctggccctttccagaaaaaaatgtgccgactcttgaccttaacctcagcaatttgggaggccgaggcaggcggatcgcttgagctctggagttcatgaccagcctgggcaacatagtaagactccatctctacaaaaaatacaaaacattagccaggcatggtggtgcacacctgtggtcctagccactcgggagactgaggtgggaggatcgcctgagcccaggaagtcgaggctgcagtgagctgtgatggcaccactgcacctcagcctgggcgacagagcaagaccttgtctccaaataaataaataatgcaaagtaaaataaataaaaccatataaaaaggaatcaatttaaaattataatgaaagctggccgggcatggtggctcacgcctgtaatcccagcactttgggaggctgaggtgggtggatcacgaggccaggagatcgagaccatcttggctaacacggtgaaaccccgtctctactaaaaatacaaaaaaaaaattagccgggcacagtggcgggcgcctgtagtcccagctactcgggaggctgaggcaggagaatgtcttgaacccgggaggtggagcttgcagtgagccgagatcgtgccacttgcagtccagcctgggcgaaagagcgagactccgtctcaaaaacaaaaacaaaaacaaaaacaaaaaaaaattataatgaaagccaaggggcatagtagaacaaattttctagagctcattaagtcaaatgagtcaccagttagtaaaacgcagtcacggggaagagagggcaggattctttgaagcagcggctctcctaaaaacaacccacccttgtccagctgccttccctcctgagggtgttccctttgactgtgtgacccccatcccctatttcccaaccgtccaagcccacctctagcataatacgagcttttaatccctctccctgaccccaacccgattttgaagcccagtctagtattttctcaaatacacttcttggctccattccttcctttccatcacctctgccttttcactgcatgcttggaccactgcagtcagctccctatgaacagttgctctctacccatccaatcggccccgcctgctgctgccaaattcaccgagggcacctctgtggtgctgcctgtggacaaagtccaagccagccacctcacccacctacaggtgagtggggagcagccagcgtgtccagtggtttaccccatcgccacagacttggtgatgtgtcgatgtgcagagaaggggtgttggcagccacaacacaagcaaccccgccccatgtgagatctaagatgggcgtgctgggagccacctctgagaatccaacagaaggcagaggggagaacggctcacacggcacaaacactccttccttttttttttttctttttcctttttgaaaggagtctcactctattgcccaggcaggagtgcagtggtgcaatctcagctcactgcaacctccgcctcctaggttcaagcgattctccagcctcagcttcccaagtagctgggattacaggtacactccaccatgcccggctaatttttgtgtttttagtagagacggggtttccctatgttggccaggctggtcttgagctcctgacctcaggtgatctgcctgccttggcctcccaaagtgctgggattacaggtgtgagccatggggcctagcctccttccatttaaatgtatgcctaatttgcccattgagaacggctgagacgcattttaagtggccagggtctacttagagttagtgctcatgaccaggcccaggtcaagcctggctggccagatggtgcctttgacctgctctgtctctgtgcaaaggaatgagctgaaggatgggggtgcagtgtgtgggcagtgggctggggctggcaggactcagtgactaagggaagagaactttcctcactaccagcctgtcttttcagggcaccgcggggggctttgggacttggtgatgaacacagcacagagagctgtccagcatgcgggtccctggcttctcacacttcccaggctccttcagaggctctctccaaagggagctgctctctctagaacccatgaatttggaatataggcaaccactgcattggggaccactgacctcaaacatagagaccagagcaaatggggctcatcacgtgaaactcatctggaactctagcaggttcttttatatatatatatatatatatatattttttattattatactttaagttctagggtacatgtgcacaacatgcaggtttgttacatatgtatacatgtgccatgttggtgtgctgcacccattaattcatcatttacattaggtatatctcctaatgctatccctccccactccccccaccccacaacaggccccagtgtgtgatgttccccttcctgtgtccaagtgttctcattgttcaattcccacctacgagtgagaacatgctgtgtttggtttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttatattcctttggttatatacccagtaatgagatggctgggtcaaatggtatttctagttctagatccctgaggaatcgccacactgtcttccacaatggttgaactagtttacagtcctaccaacagtgtaaaagtgttcctatttctccacatcctctccagcagctgttgtttcctgactttttaatgatcgccattctaactggtgtgagatgttatctcatggtggttttgatttgcatttctctgatggccagtgatgatgagcattttttcacatgtctgttggcgaactctagcagcttcttttcacaagttcatggagagaggtttcccactgagggaatcacatctgtctgatcaaaagaggcttgggaaatggctctcctgttcattccctgaaaacctctgatggaaccactgccactgtggcagccccagcactggcaccccagccatgattggtgccccagccacatctctgctgtgagccccagagccctggttaattaatcatccacgtgttgatggggagaggcccattcacaaaagcgacataaagcccagggagacgtggccgtggcaagaagggtgtgggactacattccgcccccaactgagagattcagaaaccagaaaaaaatggaaaaacatactgtgctcttgggtgggaaaactaaatatcatgaagggagcaatttttatagttttggcctataatacaattccagccgaaatcccagtggaactttgagaatttgcaggaaaaaaaaaaatgtctaaagtacatctggaagacaaacttacaagaaggtcaaataattttgaaaaagaaaatgatatctaagcccacctagagaataagacttgagatccaaagctaaatcaggaggctctagcaaaattgacagataagcaggacagagtgcatggtgcattcacctggggaagagggcagattggtctacaaataggcctgggtccactgactttagctgttatatttggggagaaacttttcaacctcactccatcttaaacctaaaaatattccagatgaattaataaatataaaaaattagaccactaaaaatgtagaagaaaatggatgatctttctataccatagagcaatggaataaatcacaaaggaaaacagatttgactatataaaacttaaaccctgcccatcaaaaaccatcagaaaccaaaataaaaggcaaccaactggagaagatagttgccacaaatatgatcaagggttaatgttattcataaattaagagcccacacaagtcattagaataagcactgagacctgaacagacaagcaaaaagaatgagagtgggtcggcgcggcggctcatgcctgtaatcccagcactttggaaggctgaagcaggcggatcacttgatcccaggagttccaacaccagcctgagcaacatggtgaaaccctgcctctacaaaagtcataaatattagccgggtgtgatggcacacgcctgtagtcccagctactcaggaggctgaggtgggtggatcacttgagcccgggaggtagagtctgcagtgagccaagatcacaccgctgcactccagctggagcaacagagtgagaccctgacttaaaagaaaaaaaaaaaaaaagaggagaaaaatgctgatctcactagtaattaaaacatcaggccaggcgcagtggctcacacctttaatcccagcactctgggaggctgaggcaggcagatcacttgagatcaggagttctagaccagcttggccaacatggtgaaatcccgtctctacaaaaaatacaaaaattcgccaagcgtggtggcacatgcctgtgatcccagctactcgggaggctgagacaggagaattgcttgaacacgggaggcagaggttgcagtaagctgagatcgtaccattccagtccagcctgggctacagagcgagactctgtcccagaaaaaattaaaacatcacatatttaaacaactctaggatatcatttaaaaaaacattaatagactgttttttagagcacttttaggttcacagtgaaactgagtggaaggtacagagacttcccgtatgttccctgccctccacgtacagcctcccccactgccaacgtcctgcaccagagtggtacacttgttacaaccaatgaatcctcattaacatatcattatcacccaagttcatagtttacattagtaaaacatcatctttcatctataagcacaaaaattttttggcatttatttaggtgtatgattaactcagtgttgacaagactcacacttcatacccacttgcactgcatctgagaagcaattggtgtctacagccgctacaccctcaacaagcccgatcttgtttgaaaagcaattggtgatgcttctcaaaattctatggacaaagtcagccgggcatggtggctcatgcctgtaatccctaaactttgggaggccgaggcaggcagatcacctgaggtctggtgaaaccctgtctctactaaaaatgcaaaaattacccaggcatggtggctggggcctgtaatcccagctactcgggaggctgaggcaggagaatcgcttgaagcaaggaggcggaggtttcagtgagccaagattgcaccactgcactccagcctgggtgacaagagtgaaactccatctaaaaaaaaaaaattatggacaaagtttttcaaaaagatatttaatgcaactttatttgtaatattggaacatctgaggccatttcagtgctaactattaggggatggttaggaaaatatggtacatatgtggaaaggaacatttggtagttagtgcccctgatgtttacaaaggcttttagtgaccaacaaatgctcatgctataatcttatgtgaaaaaagcaagtagcataattgcaactatatttttaatgcatagaataaaaggctagaaggaaatatcacagatccttgacatacattcccaaacctttgtaaatccgcggattcatgaaaacagacacatttgcacaagtgcctgatcttttctgttatacattcattagaagtcaagccctggtgccacaaagtatctgccttttcaaatgtgatcagaatgttctcttttgcttcaaggccatttttcacgaagcagtggcatttttgcctcttcatcagagtcaccgtgtgccctggaggactgagaacagcagagccgttttaggatgggacagggcagccaggaggattgggctcactccctactgagtgcctcactcccgtacagcccccatagaggaagaggggttcaaatttattcctcagccagatggcatgtgccgcctgtcctggaatttcacatcacttatgatggaccaaaattccaaaagctgaatccatgattgtcaaagtctggtatggcaggatgtcaacagtaatcgtttctgggcagagggatgattttctcttcccatcttgctttgtataaatacattttctataataaggttgtattacttttctcatcaagaaatagcaaagtactgttttactcaaaatatgaatagagccaggcatggtggcagcttatgcctgtaatcccaacactttgagaggcggatatgggaggatcactttagcccaggagtttgagaccagcctgggcaacatagtgagacccccgtccccactcccccaaagaaaacccacaaagcatttatcctggattattcacaggggccaaaaaaaaaaaaaaattcaggcctcctatagccatgagctacgaatatgaaaatatgcaaatgtgtaagaaaagccagcacatccgatttttacttttactttcacacctctgtccaccatgttccaagagaagaaacttggtcattgaaaggaatagatcaaatccaaagaacaaaaccactgtgctcattaaacttcttagtgttcacaaagctttagctgcaggttgaatggggcaacccgaattggctggctcacctgggctgcagggagcagagatcgcgacactgcactccagcctgggcaacaaagcgagactctatctcaaaaaaaaaaaagttcataaattcaaagttatgaattatttttaaaataataataatttacaataaagatgaggacaaagtgtgagtaaatggtggtttctatccagctctgttgagctgaagtggcatctccctgctggggcttttggggaagaagggtgtgtgttgctcttcagatcccaagcctcatgcccctactgggccctgtggggtgcttctcagcccaccaggagagccaccgttggaacacacacgtgggggacctggtgggtgccggtgtggtgaatgggggccacagcctgactccaggaagccagcaaactcggagctggaggagtcaggacacccccgatgagtcaagagttggttttgctgccagttgacatctgattgaaccatctcttcacttctccgtgcctcactttccttaccagacaggctctgctgatgctgtccctctcctgttcagtcgtgccctcaccgttaaagagaaagagcaaactgctgggcagcagcattgatttttttaatgaagtggaaagagagctgggaataacaagtcgggcccacctcacctgcctcacctggtgggtttatttgttttgtttttttttttttgttttgagacagagtttcaccctgtcacccaggctggagtgcagtggtgtaatctcagctcactgcaacctccacctgccaggttcaattgattctcctgcctcagcctccccagtagctgggattacaggcacctgccacatgcctggctaattattgtatttttagtagagatggggttttaccatgttggccaggctggtctcgatctcctgacctcaggtgatccacccacctcggcctcccaaagtgctgagatcacaggcgtgagccaccatgcctggccgtcacctggtggtgttgaatatgaactgctgcggtgttggtaaattaagcaagcagatagatgtaaataacgcttgggcaggaatatggagcacgggatgaggatgggcggccaactgttagagagggtagcagggaggctgagatctgcctgccatgaactgggaggagaggctcctctctctcttcacccccactctgccccccaacactcctcagaacttatcctctcctcttctttccccaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaaggttagtggacagccatgcacagcaggcccagatcactgcaagccaaggggtggcgggaacagtttgcatccagaattgcaaagaaattttaaatacattattgtcttagactgtcagtaaagtaaagcctcattaatttgagtgggccaagataactcaagcagtgagataatggccagacacggtggctcacgcctgtaatcccagcactttggaaggcccaggcaggaggatcccttgaggccaggaatttgagaccggcctgggcaacatagcaagaccccgtctctaaaataatttaaaaattagccaggtgttgtggtgcatgtctatagtcctagctactcaggatgctgaggcagaaggatcacttgagcccaggagttcaaggttgcagtaagctgtgattataaaactgcactccagcctgagcaacagagcaagaccctgtcaaaaaaaaaagaaaagaaaaaagaaagaaagaaatttaccttgagttacccacatgagtgaatgtagggacagagattttagggccttaacaatctctcaaatacagggtactttttgaggcattagccacacctgttagcttataaatcagtggtattgattagcatgtaaaatatgtgactttaaacattgctttttatctcttacttagatcaggcctgagtggcctctctttagcaagagttggttagccctgggattcttactgtagccacattaataaacaacatcgacttctaaacattctataataccatcttttggccaaattgacttcgcctcttcctctctctttccaaatgaaatgtgtttcatttcactgtcagaccacatggttggggaccccacagagcacacagccctccctctgccttcccatgctggcccttcacccactgctggagtgccaggttggtccaagggttggaccaagttgtctgaggttgtctcaaggttggtcgaggctgtctccgcgctgggttgtgctacaaggagcccttctttccatgggtgtggctggcagtgagtgctcacagcaacagcccacagtgcagcccgagggcaggatggactcagtccctgcctccatacccatttctaaggaggcaaaatggcaaacactctacttttctcttttaatgctaaaaataagaaaacaccttgcagcccagggtatgggtagtgcatggaagccgtggagttgtgaggtgggaagtgacctctgctggatatgtctattcaggaagattgctggagtgggtggggtctctgggaggtcccctgagtgtgggaagctgggaccaccagctttctcgcacagggagtggccatcccagcttggagaggttccaggactggttgggaggcacgtttcagatttctatctgttgaatcagcgaagatattggattatgaggaatttgggaattaggaaagtgggtgcaggtgggttgggggtaggtgaaggaagacatgggcgtattgggggagcaggggctgctcagaggtgttccagaagctctgggtgaggaggtgagagggaccggggaatgcagctcggcccagcctccctgcctgaggtcagccatcacgtggtgatggcaagatggaaatgtgctttctgactgctccagccagtgctgccagattcagctccccagggagggcacctgagaggctccaagccaggagatctgttttctcctttgttttgtttttttttgttttgttttgttttattatactttaagttctagggtacatgtgcacaacgtgcaggtttgttacatatgtatacatgtgccatgttggtgtgctgcacccatcaacttgtcatttacattaggtatatctcctaatgctatccctcccccctccccccaccccctgttttctcctttgaatccttcttagaggccgggtgcggtggctcacgcctgtaatcccagcactttgggaggctgcggcaggaggattgcttgagcccaggagttccagaccagcctgggcaacatagtgagacctcgtctctacagataataattttaaaaattatccgggcatagtggcatgcacctatagtcccagctactcaagaggcagaggcaggaggatcacttgagcccaggaggcggaggttgccgtgagccaagatcccaccactgcactccagcctgggcgacagagacccccatgtcaaataataataataataaataaatccttctcagtcccttcctcactgtgtccccctccactgaatttttccacctcctctcccacttcccccactcccgctttccctctccttctctccccactccatctttttctttctctgctgtttctcgtccctccctcctctccatcccacaacactgcctaccctgtccctgccccaccctggtgctcaggatgtgtgaagtgaggggtggtagcccccaagacctcaaccccgaaggttagcctgttgaaaccactttctcccagctgcccccctggcagttggtgctgctgggggaaactgggattgggggccagattttgcctcttttcctgacaaagagagatgaagagttctctcaccaggtgcctgggactggggtgtgggtgtcccagcctatcccagcgcatctgttctgcatcatgattaatagtgctgctttcagccgggcgcggtggctcacacctgtaatcccagcactttgggaggctaaggtgggcagatcacaaggtcaggagttcgagaccagcctggccaacatggtgaaacctcgtctctactaaaaatacaaaaattaaccaggtgtggtggtgggtgcctgtagtcccagctacttgggaggctgaggcaggagaatcacttgaatctgggaagcagaggttgcagtgagccaagatcgtgccactgcactccagcctgggtgacagagcgagactccgtcctaaaaaaaaaggagttttgctctgtcgcccaggctggagtgtagtggcgccatctcggctcaccgcaacctgcgcctcccgggtgcaagcgattctcctgcctcagcctcccaagtagctaggattacaggcgcctaccaccacgcccggccagttcttgtatttttagaagagacggggtttcaccctgttggccaggctcgtctgggactcctgacctcaggtaatccgcccacctcagcctcccaaagtgctgggattgcaggcatgagccaccgtgcccagtcaactccttctcaaaaaaaaaaaaatagtgctgctttctctttcaagtgtcctgatttgggtgatagtaaatgccactctacttataagggatctacctcagaatgctaattgggacatttttgtagcactctactgttggcagcaggtgatgctcacaacagcccgtgagggtggatgacgtccgcttcacagatgacaaaggagcctcatgctcagaccgtgggctgccagagcaggtccatggctgcagccccacatggaccatatttcccccttgtcactctttccaccaagctcccttggaacttcagttattaagctctcttgggtggaatccaagttagaatcacaacatgtgcctcatatggattgtgccagtgaaaaatgacattctatttagaggcagggcagcctggcttagagtcagtttaaaatatgtattatgctgcaacaaatgtaccatgatcctgtaagatgttcacaacaagggaactggatgtggggtatactgtctgtactaacttcacaagttttctgtaaatctaaaactgttccaaaataacaagttcgtttaaaattaactccaggagaccaggtacggtagctaatgcctataatcccagcacttcggaaggctgaggcaggtggattgcttgagcccaggagtttgagacaagcctgggcaacatggtgaaatcctgtctctaaaaaaaatcacaaaaattagccaggtgtggtggcgcattcctgtagtcccagctacttgcggggctgaggtgggagaatcatctgagcccaggagtttgaggctgcagtgagctgtgattgtaccactgcactccaacctgggcaacagagcaagaccctgtctcaaaaaacaaaaatgaaataaagtccaggaaagaagtaggttttaccactcttattttctgaagagaaaactaaatttaatgtgtaaagtgaggacaagttcaccaagttagtgtttgagttgcctaaaatatgtttgctaaaactattcaaagctttcacataaaacatgatcagaagttctatgccaaaacatatgtgtgtgtatatatatatgcactatatatactgtatataaaaatgcaaaatctaaattgccaaccttttagaaattgctctgaaaggaaagcatttcaagataatttgcttacccaaagaatatactttccaagaaagcaagtaatacttaaggtgttcataatcctcatcaaattaattcttgctactgaaagcttacaaggagctgttttgatgtcgggtgtgacaggtttgacttggcagaaggtgtcactttactaacaacattttaaataagtgacagaagacaagaaactacacgttaaatgccagaacaaagagtgtctaagtggatgctaagagttgaaatatggctggatacctgcccaagagagctgaaaagtagatgaaagttggttacctataaactagtgcaccctaatgaattaaaaggtgttgatgagttaacttgttatgccttccagataagacatgcaaatggggcttcttcctccttcactacttccaagggatttaacaaggagaccaatgcaaatgataaggactgtagggctcaagctggggacagattggggaaagggggaccatcatgcccatatagatgtccctgtgccctggcagtcaaggctgctgaaaaataacaaaacccagaagtctgcgtgatgctgcctctccatttgtccaaagccttcttgcggcagtttgcaggcttttgcaaaagctccaggaccaaggagctatgttcatgctggaagcttgttcaggattagctgttctttgtgggatgggtgcagccagggccaggtgtccagggacagtgttttaacaaagggcatgaggtgtctgatctcacagtggaactccacttgcctttttttcatcttctcattctgcttcatgcacagaaccagccccatcctgaaactgactctaaattactcccgccccaggtggagtgcctttctcggagttcaacagagccttcctgtcgcccaagggacaactccactgaatgcccaagccacacccaaaacctaacaagtaaaaaccaaattctgtgctcccccatcctgggccattcctggtttctctactgctgttggtgataccaccatcagcttgtccatcatgaccctggccagttcctcccacaaccctccacagcacccagggacctcacctccattccatccgacacagatctcctcaccacaaaccttggttttgcaacagcagccatgagacctttacaccctccgcccttcatcctgtcccccactgaggccccagagccattccttaaagcagcgcgccacaaactataacccacaagccaattctggtacccagcctgttttgcacagccagtgaactgacaatgatcttttcatacagccagaaaaacaaaacaaaacaaaaaacaacaaaaaaaaaccccaccattctgagcatgtgacttccatgttcaagatgtctcatgttcagaaaggcccctggaaaaggaggaaggggagctgggcacaaagggagaccctctcagctgagctcctcccatccagacattttcctggacttcctatccaatgacttcccttagcttcttatcagccacccctgtctgcccaggaggctggaagatgtggccttttaactgggcacagctctgtcctctatcatatcagggctctgttcccaaggagggtagagagaatggacaccaggtggaccctcagcagtctgtgccacagagggagtgtttgcaatttccagactaaaagtccccatgtgcttgacggggtatgtgactacaacgtgatgcttgacttttcctcatatgaccagagccactttgtccatctggtacaatgtcagctatctgctaggggccctccaggattcccagtcaattccatatctgcatcaccaccattggcactaaataaaataaaatactcaagttcctgctggtgagcatgagcagtgctacactgggcccttcaaccaaggtgacatgataatgactgaaaataatcactgccacttattggggacgtctcatctgccaggcatggtacaaagtgctttaaataagcattcaacaatttcatgctgacagaagccctgtgagccagtggagctactactatgcccattatacaggggagaaaactgaggcagagagaggttaggtaattcgctcagcctcacacaaccaataggtggtggagccaggatttgggccccatctgcctgactctctagaggctctatcttccagtcttccagagttgagtctaagccatgaataggacaattagacagcagaggaaacccattcagccaccatgtgcatgaagagtaaggaatttctgtcatacagaggggagtgaattcactgagctgagagctgaggaaccattgatctgatggctgagacaccactgggaagactggagaggcttttctgggcatgcagtgccaggcacaggaggagctgagggaagatgactaagaggtactggcaaagaattcagaaattctgatggaagctttacatgttaccatcacatccatccatctatccacccatccatccacccatatcttcctccctccacccaatcatgcatacatccagtcatctatacaccacccacccacccatccatccatccatccatcccttcatccatcccatcatccatccaattatacatacatccaatcatatatctgtacataatccattcttccctcggttcatccatccatccattcatccatccatccacccatcccttccttcatccttcctatcatccatccaatcatatatctgtacataatccattcttccctcggttcatccatccatccattcatccatccatccacccatcccttccttcatccttcctatcatccatccaatcatacatatatccaatcatacatctgcacatcaccagctcatccatctatccatttatccatccatccttccttccatccatcattcatccatcatacatacatctaaccatacatctctacatcattcattcttccatcgattcatccaattatccatcattccttcctccatccatcccattatccatttgatcatacatatatcatctatacatcatccattcatccatccatccatccatccacccatatcttcatccaatcaatcatacatacatcgaatcatctacacatcacccatccatccatccatccattcatctatccacccatccatccatccatccatccattcatctatccacccatccatccatccatccatccatccatccatgtaaccatccagtcatatatccaattacacatccatccagttatacattcatacatgcatctaatcattcaattatacatacacacatccatataattctacatccaattatacctccatccaattacacattcatacacccacctaataaattattaattcatatatccatccatataattatacatcaattatacatccatctaatcattcagtaattcacccaccatccagtcatctatccaataatacattcatccaatcatccatccatccatccacccattcatccatccatccgtccgtccacccatcatggtatgagccatgatttaccacgatggtcccctgtggacagcccaggtggggcagaactgaagggaagcccagggctgcccccataaacatttgcctcctttacatggatgagaactagatccacatgtataaatcctcatgatttgaaggtgcttttaccaacattcactcatgggattctcccaggagctctaggaggaggcaggtagagttgaggtcatctcacgcattttacagatgaggaaacggaggccctgagaggcaggtccaaggccacctgaccagaaagaagtggaactgggacttgaacccagccatcttgccccttggtcccatgctctctagcctgtaactcctgcttcctggtggggcatctccaggaggaccctatcggctggccatgggcctgccctggagtcttttgctctgtgtggccatccttcctccctcaggagagtgtgtgctcccagagcacaggctgtatcttctgagcattttgtcccttcccagtacctagcactcagctctgtatacattgggctctcaagaattctcaaccttccagagtgtaaggccttgacctgctcagccctggatactgcatgatgcattgataagcccataaaataaccagggcagattgactcccagtggccaaagtgccacagggaagggacaattcagcccttctaggaggaggaggaggtagttttctcatttctattaaggcaacaaaagctgccttactaaggacattcttggtggagggcgtgactgtcaaccactgtgatcatttgggcctctcttgcccaggcttcccattctgaaaggacagttttattgtaggtacacatggctgccatttcaaatgtaactcacagcttgtccatcagtccttggaggtctttctatgaaaggagcttggtggcgtccaaacaccacccaatgtccacttagaagtaagcaccgtgtctgccctgagctgactccttttccaaggaaggggttggatcgctgagtgtttttccaggtgtctacttgttgttaattaatagcaatgacaaagcagaaggttcatgcgtagctcggctttctggtatttgctgcccgttgaccaatggaagataaacctttgcctcaggtggcaccactagctggttaagaggcactttgtcctttcacccaggagcaaacgcacatcacctgtgtcctcatctgatggccctggtgtggggcacagtcgtgttggcagggagggaggtggggttggtcccctttgtgggtttgttgcgaggccgtgttccagctgtttccacagggagcgattttcagctccacaggacactgctccccagttcctcctgagaacaaaagggggcgctggggagaggccaccgttctgagggctcactgtatgtgttccagaatctcccctgcagacccccactgaggacggatctgaggaaccgggctctgaaacctctgatgctaagagcactccaacagcggaaggtgggccccccttcagacgccccctccatgcctccagcctgtgcttagccgtgctttgagcctccctcctggctgcatctgctgctccccctggctgagagatgtgctcactccttcggtgctttgcaggacagcgtggtgggagctgagccttgcgtcgatgccttgcttgctggtgctgagtgtgggcaccttcatcccgtgtgtgctctggaggcagccacccttggacagtcccgcgcacagctccacaaagccccgctccatacgattgtcctcccacacccccttcaaaagccccctcctctctctttcttcaggggccagtaggtcccagagcagccatttggctgagggaaggggcaggtcagtggacatctgatcttggtttagtatccttcattttgggggctctgggtgtggcctgggcctctggactttggccacggtgtttgttccagcccttctcctaacctgtcctttccagacactcggcatctaggttattagcacctcgcatactttctgacatgctcctcagtcctgattttgaccatcttctcttgcttcccatctgtgtcagtcaagactgcatttggctgtaagaaacagaaaccccaactaactgtggcatttacatgaagaggtttacttttctcacataatcagatgtctagacttggccagcacctcaagggtcattgatgctctcctgtctttattttctgtcatctttagtggttggattgttgcctcatggttacaaagtggctgctgcacttccaggcatcacatctgcctttgaagcaggaacaagttgcaaagtaaagtggccaaaagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgagaatatccagatcagattctcttggctccttcttagagccagtgatgcaagacacttcctgctcatcttgtcgggacggttttacaagttgcctgccatcctgagaaagtctacaaaacgatgccagacctcatgccagcttcccaagccttgactctcagtgctccctcaacaggattctggaagaatctcccaaacaagtcgcaatcccctctggaccctgtgcaggcatgagactcaagagcattggctcccacccctggtggagggaacactgctggggctgggatcttgcctggttgctccgcctgcacccaagacaaccataattaaaatgtccttcattgaacttggaaagccttcaaagctgacaactccttatgtgtacccggaaaggcctgggagtgtgccagggcattgctcgggagggacgctgatttggaagcatttacctgatgagagactgacagcagctcctggtagccgagctttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaagaatcaaatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatggctcgtcctggcccctctaaggtggatctcggtggtttctagatgtgacagcacccttagtggatgagggagctcccggcaagcaggctgccgcgcagccccacacggagatcccagaaggaaccacaggtgagggtaagccccagagacccccaggcagtcaaggccctgctgggtgccccagctgacctgtgacagaagtgagggagctttgcgtgtttatcctcctgtggggcaggaacatgggtggattctggctcctgggaatcttgggttgtgagtagctcgatgccttggtgctcagttacctccctggctgcctgccagcctctcagagcatttagggccttctggacttctagatgctcctcatcttgcctcagtcagcgcgtcagttccagagacttctctgcagggttttctggggcaggtggtggcagacccgtgccttcttgacacctgaggtcagtccaccctcctgctcagactgcccagcacagggtcacctcccaaggggtggaccccaagatcacctgagcgcacagagggtgcagatgactggaccacaccttttggtgatcttaatgaggtggtcccagaggagctcagacatgcaatctagcatccagttctgggactctgtctccttttcaaacgtattcatgtagaacaggcatgacgagaatgccttgtcaacatgggtgatggggaatcaatcagacagggcgccgggctcaaggctgcagtcacccaagagtggctcagcccaccaggccctaggaaacgcctgcacagcctggagctcctggagtcatttccttcatgtcttcttcactgcacttacgtaaagatgccagccattggtttggtgatttggagggtgcccagttgcccaacaagaaatgcagaagaggcctagccaggatttcaccagcagtggagagtagagaagatgtggccagaaaagagtttcctttccctcctaaagatggtactccctgcagctactggggaagcctgcagcattctctagggctctgtgtgttgagagcagccccaccctggccccttctgagtgcatttctgctttgtgacttgatccgtgaagtcccctgagatgggcagaggggatgtcctcgaagctggggcagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcgagggctggcagggaggggaggggtaagagaaacaggaaggttcttactgagttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcgtcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagaaagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtttagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaaggtcagtgaactggaattgcctgccatgacttgggggttggggggagggacatggggtgggctctgccctgaaaagatcatttggacctgagctctaattcacaagtccaggagattttagggagttggttcttatcaaaggttggctactcagatatagaaagagccctagtggtttttttctaataccatttctgggtaattcctaaggcatttagtgttctgaaagatgctagccttgtccagcctgggagttgagaatgaatgtctaacagaaactctaggccgggcgtggtggctcacgcctctaatcccagcactatgggagacccaggtgggcagatcacctgaggtcaggagtttgagaccagcctggccaacatgtgaaatcctgtctcactacaaataaaaaaattagccgggtgtggtggtaggtgcctataatcccagctactcaggaggctgaggcaggacaatcgctcgaacccaggaggtggacgttgcagtgagccgagatcgcatcattgcactccagcctgggcaacaaaagcaaaactccgtctcaaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgttagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaaggtgtttcaggttggagctgcagtctgttgagagtaagctatgggaaggcctgtatacgaggggtggacttttcttctgtaagtgtccagagaccaggcctcctgaagagggcatgggggcttaacttacctggactactgtgtttacaatactcatttatcttgaactcctcctaacccctgagaattgctacatttagtatttgctgagtacttcctagcatcctagggaatcaatagaacattctcccaaccaggctgggtgcggtggctcatgtctgtaatcccagcactttgggaggccaaggtaggcagatcccttgaggccaggagtgcaagactagcctggctgacatggtgaaaccccgtctttactaaaaatacaaaagttagccaggcatggtggtacacacctgtaatcccagctacatgggaggagtaggaggcaggagaattgcttgaacctgggaggtggaggttgctgtgagccgagatcatgccactgcactccagcctgggcgacagagtgagtgagactctgtttaaaaaaaaaaaaaaaaaagaacattctcctaacctggcttcttcctccaggggtgtaattaatcatgtcagtttcctcattgatacacacacacacacactacaatcctgtatccattacttttcaaggtacatttactatttacgtttggggtccttgtctcttttttaatagtgtttcttaaagtcttgtattatatcagagtacagtaacatcccagtcaagagcactctagtaagctctaggaggaaagcgacttccggaaggcagtggagacctgtcctgttggggcagcataggggcagcccctgcctctggtcagttctggcgctcaggctcagggttgcctctgggctgttcttcccagagactgacaaagggctcccataaggcacctgcagagcctgtgagaagctgaagtcaatgttttcctgacaccagttgatctgtgcaggatccattgatttaaccacctgctgtgtggcatgcactgtggtcgatgccaggaacaggaattggaggggcccatgagcatggccagtatcacaggctggaggtgctgctgcgctctgaccgggcctcttggggatgagcccatgtcaaccaccttgcctccgatggggtcgggcccacaggttacctttgtgtgtccatgaccacaccttcctccccgacctcatccaaatctctttcttttccaagcccctgaatccttcagggctgcaggttttgtttaaagcagagctggtgagttgcataggttgttgcgttgggactagatggggtgttcaaagagttgggagttaaaaaacataaagggtatttattaggagaaccaaggagtgtaattctcctgttcttaatatgcggccaggttaatgaatgtcacgtgaatgaaccagaaaaaaatgaagtgtgcccttgatcagctgggttggtgtgcagcaagctgtgtgaccaggggacagcagtggtcctgagggccgtcactgtctgccgtgcagagcccttcctcccacgggggcctacctcacctgtgccaagggcttgtctgtggtcagtgacctggatagatctgaatggggcttctttttcgaggagtcttatggcaggtctctcagtaaagactccattcttgatgatcacacattttggattttccaaatctgtcagagaatgggcttgaggcggggtttgtgggcactagtttcactggtttcatttaccaaaaaggggagcagaagtcaagtatggtggctcatccctgtaatcccagaggcaagagaattgcttgagcccaggagttcgagaccagcctgagcaacataaggagaccccgtctccacaaaaatgaaaaataacattttagtcagacgtggtggcatgcatctgtggtcccagctgcttgggagggtgagatgggagggttgtttgagccctggagttaaagttgcaatgagctgtgattgcaccactgcactctagcctgggtgacagaacgagaccctgtctcaaaaaaaaaaaaaaagaaagaaaaaaaggaaaaaaaaaactcatgcctgtaatcccagcactttggggaccggggtgggcagatcacgaggtcaggagatcaagactatcctagccaacatggtgaaaccccgtttctactaaaaatacaaaaattagccaggtgtggtggcacgtgcctgtaatcccagttactcgggaggctgaggcaggagaatcgcttgaaccagggagtcagaggttgcagtgagctgagatcgtgccactgtactccagcctgggcgacagagtgagactctgtctcaaaccaaaaaaaaggggtggggggcgggggcaggagaacagtgagaggtagggagaggaaaggggattctcgctacacccaaaccagataccatctagaggctagaatctttgggaggctcaaattccctagaaagcaggagaagcttctgtagccctcccgctttcccagtagattaagcccagggcggctccagatgtgtgacatgctctgtgcccaaccagagcccatcataggcagaggaataacacccacaccagaagggccctcggaggtcaccacgtccaagaaccctctttacagatgaggaaactgaggcccagagaggggagagccacctagcgagctggtggcggctagaccaggagagctgtcattccaagcaagcaaaggcaacgagacgagcccagagctgtgctcccatctctttgttagggggcctgggatgccctctcagtgtcattttgtccaggatgatgctccctctcttaagcgattaatgcgcccttgctaaccttttgctatcgctgcctcttcaaaccagaggagttgagagttccgggccggcagaggaaggcgcctgaaaggcccctggccaatgagattagcgcccacgtccagcctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaaggtctgtgtcttgagcttcttcgctccttccctggggacctcccaggcctcccaggctgcgggcactgccactgagcttccaggcctcccgactcctgctgcttctgacgttcctaggacgccactaaatcgacacctgggtgcagctgctccactccctcggcctcctcccgtgctcaggctgtggccgcacgcgcccctcacgcttgcccgccactctgcatgtcaccagcacccccgctccgtgctccccaccttgtttgactctctggccacttgatttgtccacaacggcccatcagcccacaggaggtttggtgggtgccttccaccgacaggatgacgggtgccctcatggtgtctagaactctccaaccctcccatgtaggcataagcagccccactttgcagatgaggaaacggaggctcagagaagtacagtaacttgccgaaggccaatgagtagtaagtgacagagccaggtttgggatccaggtaggttgtctctgaaagacacgcctgtcctgcatcccacaacgcctcccaggaggtgctggagtgtggacgcctaacacagagatgtgcagggcacacacagcaggtgacacacacagcatccagaggtggcccagagctcatgctgtgcctttggcccagtgccctgcccccacccactctgccttgtggcaggaagacaaggagcagacacaagatctccctggtccacatgccaccacctccctctgcagaggacaaggggatcctcatgctggcattggagggggttgagcagggcccaccttgagccctcaggagcacgaccacagcagccctgcagggagggattggtgggaggagagtcccaagtatcagggagaggagagttggtgtcccacaggagacctcagagccacaaggcgagcttgttcataaatttgggacccttagcatttcacagttatttgcagagcccagaaatggatgttactgaagctcacagttgcaagcatctgttaaatttttattagattttacttttagggaaaactttgaaatgctataaagaagcctgtgtttaaaagttaagacagaggctgggggcgatggctcacgcctgtaatctcagcactttgggaggccaaggcaggtggatcatttgaggttaggagttcgagaccagcctggccaacatggtgagaccctgtctctactaaaattacaaaaaattagctgggcgtggtggcgggcacctgtagtcccagctactggggaggctgaagcaggataagtgcttgaacccaggaggcggaggttacagtgagccaagatcacaccactgtaccctaagcctgggcgacagagtgagactctgtctcaaaaaataaaataaaataaagttaagagagaaaaaaatatatcctatatcctttgttaaattccaaaacagtaggggacaaataactgacttgacaggttactacaatatttcctgaaatgatgttttcttgaatactggcctactagaggttcataggtgtgtttggattaaaaaagagttccatggcccagtgactgggggaaaaaaataaaagactaaagtaagttaaacaggcttttctgctgcaggacttgtcagagcctttaatgtactaatggccattgtgaccctctgagaaggtcacagagtgggtttcccaaacttacttgattctacctgctaacatttcctggaggaagtttgggaaatgccgatttagcagattcttttgttgtgccgtggatggtgctggttgatgtgggcaaaacaaagaacacgtgagtcagatccgcctggggctcttactaaagtgcaggttcccaggtgccactttaggcttacagacccagttgtggggtaagcctgggagtcttttagcaggtgattctgccacatagtatagttggaaaacctctgggcatactcattgctggtccctctagaaatccaggtgacaatagccaatgagaagctccaagagacccagttgtccatggggtagagggaatgtgatattgaaaccaaagaagaaaatctatgatcagttttcagcagtgactgtcaagagaaggagaagggtgagttagcgctgatgctggctgacaggtcagcgggttggtttcaccaaggagtgtgatgaaggctgatgttgtctgtgggaatgtatgatggtaactggtttgtagctaatttggggaagcagtgagaattcgtgccctttgaagaccagtaagtggcaagaaacccaccaggcctggctcagggctgggctgggcttggctcgtctcagagcagctggggctggtggccaaagccaccattagtgaggggcaggccctgggggtacaaccagcaactaggggacaaagacaaccctgccagcctctcctattctggaggcgtgtgaccagaaatggagatgggttggtcagcataagatggccaggaaggtggaaatcaggactgctggcaatctagccacatgggcaggggagccgggtggttccaggcagtttccaaggccaagagggtgagcaggcacctcacagggaatcagggccaagcctggctgcagtgtggagacaatgcacccacccccatccttggatcttgcaggaggctgggtcctcactgagctaccaacatccatggccctgaggcttttaaaacacccatccatggagtggggctggtcccagtggggtgaggctgaccctggcagaaacagggcaggagcctgtgggttagggagactgcaccttccttagatagcctccatgccatcatgtccccgtgacagtttctgctgcgtcccctctgcatggtcccaccctcggccagcctgctgccccctcttgccaggttgcgctaatcagtgaccccagtgtgctgtgttgatactaacaatgcgaggcctagcagattcaagggaaaagagaaccaactgggtttccaccagacccaactaaacaaacatggacctatcccagagaaatccagcttcaccacagctggctttctgtgaacagtgaaaatggagtgtgacaagcattcttattttatattttatcagctcgcatggtcagtaaaagcaaagacgggactggaagcgatgacaaaaaagccaaggtaagctgacgatgccacggagctctgcagctggtcaagtttacagagaagctgtgctttatgtctgattcattctcatatataatgtggggagtatttgtcactaaagtacagctgtcatttaaagtgctttgtattttggggcaggcttttaaaaagtccagcatttattagttttgatacttaccccagggaagagcagttggcaggttcatgaagtcatgctcctaattccagctttcttagtgtactttcagtgagaccctgacagtaaatgaaggtgtgtttgaaaaccaaacccaggacagtaaatgaaggtgtgtttgaaaaccagccctaggacagtaaatgaagccatcttctcactgcataaactgcacccagatctttgcccatccttctcagtatttcacttcacccattgtttactgtctcaatgactggggaaatgtctggggaaatgctcccgtaattgcacagtggcgtttttcctggaaaatcccaccatggctctagataagacctatttttcttaaaggtatctaaaatttccagcataaattctgtctgaaacacctgaattttaatcagtactggagcccggagggcatctccagttgccacatagctctgagcattcagtggtgtgttgagggctgctcccggaagtgcctgcagagtcagggctccccagcctcatctagtgaggcagtggaagggcctgtggggatttggagagctggcctgggtctctgaagtgatagtgacagctgcttgtcaatcacggtgcacatttagtgccgggggcagggggcagggaataccagcctcatgcatgcatgcattcatttgttccttccttcattcattcattcagtacacatgggtacaacatccctgccctggagttgcccagagtctagggaggggaaagatctattaccctgggcctcggccagctggggagtgctgctggtggagaggggccgtgtgcagcgagggaaggaggagtcgtcaatacccccaccccagctttgctttcttgtcatcagccccagggccccagcctgtgtccctcctctcccattgctacttcatctcctgggtcctccttaccaagcctgaccacacagagggccttggccgcttccatggggaattggaaagcaataagatagcatcccctagaagcccagtgaagtctgggacaggacccttctctgagctctgacttgctcttggaaacacttcgaggcttagcctccccactttgtttcccaagagtgtgacctgttcccctccaaacacccccttctcctccagggccatgcccacccgtcaaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactgaaaaaaaaagaaaaagagataacattggaggcttggcacagtggctcatgcctgtaatcccagcactttgggaggctaaggtgggaggatgtccccagcccaagagttctagaccagcctgggcaacatagcaagaccccatctcaaaaaaaaaatttaattggccaggcagaggtgggaggatcacttgaacccaaagggtggaggctgcagtgagccgtgatggcaccactgcactccagccagggcaacagagggagaccctgtctctaaaacaaacaaacaaacaaacaaacaaaagagttaacattggccagattaggattcaccagatagtgttaatattagtttgatttgagactttaatcagaaagcacatgtgtggtgggggtgggtgtaacctaagtcaggtagaatctttccaacttggggggggcacactcctgattgtagccatatgagtctgtcagtgtggtggaagagaccatgggttaatgggcaggtaaaaaagcaccttgcctggaattgagtagaaagtaaggcccttcagaccccgtgacacacttggggacattttcttgagtaacatcctaagattcatgtaccttgatgatctccatcaacttactcatgtgaagcacctttaaaccagtcgtctccaaattcaggggcacagtaacatccaacaggctggagaaagaacgtactagaacttccattcctttttcatgtcctcttctaaaagctttgtcagggccaggcgcggtggctcacgcctgtaatcccagcactttgggaggccgagacgggtggatcacgaggtcaggagatcgagaccatcctggctaacacagtgaaaccccatctctactaaaaatacaaaaaaacgagccgggcgtggtggtgggcgcctgtagtcccagctactcgggaggctgaggcaggagaatggcgtgaacccaggaggcagagcttgcagtgagccgagattgcaccactgcagtccagcctgggcgacagagcgagactccgtctcaaaaaagaaaaagaaaaagaaaaagaactgtgattggggaggacggtcactttcctgttcttactgatcagaagggatattaagggtacctgattcaaacagcctggagatcactgctttcaaccattacctgccttatttatttttagttactgtccttttttcagtttgtttccctcctccatgtgctgacttttattttgattttatttatgtttatgtttaagacatccacacgttcctctgctaaaaccttgaaaaataggccttgccttagccccaaacaccccactcctggtagctcagaccctctgatccaaccctccagccctgctgtgtgcccagagccaccttcctctcctaaacacgtctcttctgtcacttcccgaactggcagttctggagcaaaggagatgaaactcaaggtaaggaaaccacctttgaaaagaaccaggctgctctgctgtggtttgcaaatgtggggtttgtttatttgttttttagcctcaaagacctttcttcaaatgagttctggcatagaagcaccgtgtaaaatagttagaattctgggcaaaggggaaaagagagctgggggccatccctctcagcaccccacaggctctcatagcagcagctcctaagacacctggtgggaccttggtttcgaaatcgctactctaaggctgggcacggtggctcacacctgtaatcccagctctttaggaggccgaggagggtggatcacctgagatcaggagttcgagaccagcctggctaacatggcaaaaccctgtctctactaaaaatacaaaaattagccgggcgtggtgttatgcgtggtggtaatcgcagctactcgggaggctgaggcacaaggattgcttgaaccccagaggcagaggttgtagttagctccagcttgggcgacagagcaagaccctgtcgcaaaaattgtttaaaaaacaaacccaaaattgctactctcattgggttcctttgcccattcctgattttggcaagagaaatgcttccagattgccctgatctgggtaggacagcatcacgccatagcaacactgccccgtgagctcactgccccctcaactagcttgtggtccttggttaatgtcagtttcttttttgagtttgtgttatgtctaagggtcatctgctgggtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcgagagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactaatgtcctgccgatgattgacatggagtggagagtgacctgatcattgctgtgagctctgctggccttggcacaactcatgctgataactaatgcacacagttcctctgggaggaaatgtcctcagggaacttggagtttgggtggggatgtgggtttgtgtgcccagcaagcccttgtggttgtagcagacactagtggcatctaggaggcaaagggtcaccccagtcttagccacgttttgagtcaaggtggcggagtggggctggtgttgactcttggtggcagtaacttttcccaatggtgaaaaacccctctatcatgtttcatttacagggggctgatggtaaaacgaagatcgccacaccgcggggagcagcccctccaggccagaagggccaggccaacgccaccaggattccagcaaaaaccccgcccgctccaaagacaccacccagctctggtaagaagaacgttctcttgaatcttagaggaagctgaagctctcagaggtacagccttcattttaggaggccttaggccactgagaatgaataacccctggcagctggtcagcagcttgcagtttactaagcactggagtcttcattgccttctcagtccttttgatttctgaggcaaatgttgaatccctacctttttttttttttttcttttgagacagagtttcgcttttgttatccaggccggagtgcagtggtgtgatctcagctcactgcatcctccacctcccaggttcaagcgattctcctacctcagcctccctagtagctgggattacaggcacctgccactatgcccggctaattttttgtatttttagtagagacagggtttcaccatgttggccaggctggtctcgaacgcctgacctcaggtgatccacctgcctcggcctcccaaagtgctgggattacaggcatgagccaccactcccagcctgaatcctcactttttatcaatgaagaaattgaggctgattctgcagcatgataaaaaaaaatacagaaaaaggaaaaaaaagaaagaaatcgagcctctgagagtttgcttgactgagtctaaccagctcattttaaacccgaggaaaatgcagtcacatgactactaagtggcagctctcggagcctctctggccccaagtccagggttccatagaggcagccccagcatggcatgttttcagtccccaaatgagactctggagacaaatgtctctggagacagagcagcagcctggataagtcacaatgggtgacgtcactcagggctcaacccctgggcagcttaacttgctagggacgttaggagtctgctgcaaaacctgagggtcttagctgagcagtcacaggctgggcccgttgccctgggctcctgtgagtaaaacccagtcaattttgagtacccagtaaggcatccattgagttattttgcagccaggagtgctattaagaacagtcgcggctgggcgtggtggctcatgcctgtaatcccagcactttgggaggccaaggtgggcggatcacctgaggtcaggagttcgagaccagcttggccaacatggcaaaaccccgtctctaataaaaatacaaaataattagctgggcgtggtggcgggcgcctgtaatcccagcttctcaggagggtgaggaaggagaatcacttgaacccaggaggcagaggttgcagtgagctgagatcgcaccattgcactccagcctggatgacaaaagtgagattccttctcaaaaaaaaaaaaaaaaaaacagtcgtcctctttggggattagggacagcctgcctgcctgcccgagcacttctctcttccattgccccagtgaagtattccaggcccctgggtttagactctgcaccatgtaggggtgtctgacctgcacttgctccttggtggcacgggcagcctatggcacttgctgcgggctgtgaccaaagcctggcctggatcttggatcttggtgactctgcttctccctggcctgagggagctgcccagagcctgcccaccacctgctgcgtgtctttgcggtggcatttctcgcacacatgccgtgcggtggcacccccaaggatggccattcactaaggcccattgtttttgtcttttcgcttcgtgttttctggcctggtgtttttctcatatacatgtgatccagggataattcccagaattttgacaggattttaagtagcgtttggatcctgctgtttttttttcacttaacatcgggccagttgactcacactctgttttttgttgttgtttttttgagacggagtctcactgtgtcacccaggctgaagtgcagtggcacaatcttggcatactgcaacctctgcttcccaaattcaagcagttttcctgcctcagcctcctgagtagctgggactacaggcacaggccaccacgccctgctaatttttgtatttttagtaaagacagggtttcaccattttggccagcctagtctcgaactcctgacctcaagtgatccgcccacctcggcctcccaaagtgctgggattacaggggactcacactttgtaacaacctgaaacaacgtgatgcatttccctttgggtcttacctgctcttcggtggctgcctgcaggtggagagaccctcccccttgggcccctcgaccttgtttcagaatggggcccctgctgggccagctgtgggtgcctgccacgtgaaggactcattaaggccctgtttaagcctgatgataataaggctttcgtggatttttctctttaagcgactaagcaagtccagagaagaccaccccctgcagggcccagatctgagagaggtactcgggagcctacttcgctgggagcagcctccctttgcgtgtgtggccattcactggcttgtgtttctagagccgggaggacccttttctgcaatgcagggttcacacagggttcgcagcctgaagatggagcagtccgaattctcttccctgtgcagtttgcgcagctgtgtttgtctgatgggctttctaatcctgtgtgctctccttgacttcagggacaatggcattacaggcatgagccaccatgcctggctgtctccctatgtttcagatgaagacataggcttaaggaggtcaggtgacttgcccacgaccactctgtaaataagaggcatgaaaagtatttggagccaccaccaccaagcccactggtcaccctgggtctctgaagtcagggaggcaggaggatgggaggtctgaggaggcagagaggctgagcctggaggccctggaggccgaggccccatctgttgtttccttatgtggaaaataagaggcttcatttgtcctattgccacagagcgtactacttcaggaacatccaagacatggaaatccgcagggcacggtggctcacgtctataatcccggcactttgggaggttgaggtgggagaatcgcttgaggccagaagttcaagaccagcctgagcaacatagtcagaccccgtctctataaaaaacattatttttaaaaaagacatggaagtcaaattctaaaaactggtgctggctgggtgcggtggctcatgcctataatcccagcactttgggaggccgaggcgggtggatcacctgaggtcaggagttcaagaccagcctggccaacatggtaaaacctctactaaagaaatctttactgaaaatacaaaaatccagtctctactaaaataagtctctactaaaaatacaaaaattagccaggcgtggtgctgcacacctgtaatatcagctactcgggaggctgaggcaggagactcgcttgatcccatgcagcggaggttgcagtgagccgagatcacgccattgcactccagcctgggcatcagaataagactccgtctcaaaaaaaaaaccacaaaaaaacaaaacaacaacaaaagaaaactagtgcttattcgtcactggccaagctgcccattggctacatgggtgcttcaaagagctgcccttctccaggtctggccagcaggtatgtgttacagcaaatgcctggggcagcggcaggggcattgctgcgggaagcttctggacttgcaggaaagctaagttctcagactgcaggggagctaagcacacctcggcacagggtgaggcctgcggttctcagacttcagtctttgtggagcttgagaaaaatgaggctttgcaggtcccacccctagagattctgctctatccactcttgaaggggatcgagaaatttgcattttgcaactcccactttcctccttgaaagctccggagattctgacgcagggttccgtgggccacactttggaaaatacagacccatgagatagaataccagactgttgaagtgtaacgggggcctgggaagtgcagtaacagaagcaagtttgagggtaaaggacacccagaggagggagggacagcatctgcatggagaggagaagagaccccccagcagcttccagggtgttggaagggtgcgctagtaactgctatgcatggcaggtggggaactgtacgtcagggcacagcagcatgaagcggtatggctcgtgtggacagctagggacaggcaggcgtggagcaggcatcctgttctgaaggccaaatcccacagaggagccagggtgctggcaggagccctgaactagccgaacagctgaacagctgaacattcaccctgtggggaaagggtcagaagcgtccaggcttgagggcacagctgggtctcgtcactgcatcacccttatttaggataaaggccctgaagaattgtattagaggttggcaaagcatatctaccacctcctggagccacgctggccgcagggattataattatttccattttcaaattaaggcctctgagctcagagaggggaagttacttgtctgaggccacacagcttgttggagcccatctcttgacccaaagactgtggagccgagttggccacctctctgggagcgggtattggatggtggttgatggttttccattgctttcctgggaaaggggtgtctctgtccctaagcaaaaaggcagggaggaagagatgcttccccagggcagccgtctgctgtagctgcgcttccaacctggcttccacctgcctaacccagtggtgagcctgggaatggacccacgggacaggcagcccccagggccttttctgaccccacccactcgagtcctggcttcactcccttccttccttcccaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgagagtggctggctgcgcgtggaggtgtggggggctgcgcctggaggggtagggctgtgcctggaagggtagggctgcgcctggaggtgcgcggttgagcgtggagtcgtgggactgtgcatggaggtgtggggctccccgcacctgagcacccccgcataacaccccagtcccctctggaccctcttcaaggaagttcagttctttattgggctctccactacactgtgagtgccctcctcaggcgagagaacgttctggctcttctcttgccccttcagcccctgttaatcggacagagatggcagggctgtgtctccacggccggaggctctcatagtcagggcacccacagcggttccccacctgccttctgggcagaatacactgccacccataggtcagcatctccactcgtgggccatctgcttaggttgggttcctctggattctggggagattgggggttctgttttgatcagctgattcttctgggagcaagtgggtgctcgcgagctctccagcttcctaaaggtggagaagcacagacttcgggggcctggcctggatccctttccccattcctgtccctgtgcccctcgtctgggtgcgttagggctgacatacaaagcaccacagtgaaagaacagcagtatgcctcctcactagccaggtgtgggcgggtgggtttcttccaaggcctctctgtggccgtgggtagccacctctgtcctgcaccgctgcagtcttccctctgtgtgtgctcctggtagctctgcgcatgctcatcttcttataagaacaccatggcagctgggcgtagtggctcacgcctataatcccagcactttgggaggctgaggcaggcagatcacgaggtcaggagttcgagaccaacctgaccaacagggtgaaacctcgtctctactaaaaatacaaaaatacctgggcgtggtggtggtgcgcgcctataatcccagctactcaggaggctgaggcaggagaatcgcttgaacccaggaggcagaggttgcagtgagccgagatagtgccactgcactccagtttgagcaacagagcgagactctgtctcaaaacaaaataaaacaaaccaaaaaaacccaccatggcttagggcccagcctgatgacctcatttttcacttagtcacctctctaaaggccctgtctccaaatagagtcacattctaaggtacgggggtgttggggaggggggttagggcttcaacatgtgaatttgcggggaccacaattcagcccaggaccccgctcccgccacccagcactggggagctggggaagggtgaagaggaggctgggggtgagaaggaccacagctcactctgaggctgcagatgtgctgggccttctgggcactgggcctcggggagctagggggctttctggaaccctgggcctgcgtgtcagcttgcctcccccacgcaggcgctctccacaccattgaagttcttatcacttgggtctgagcctggggcatttggacggagggtggccaccagtgcacatgggcaccttgcctcaaaccctgccacctccccccacccaggatcccccctgcccccgaacaagcttgtgagtgcagtgtcacatcccatcgggatggaaatggacggtcgggttaaaagggacgcatgtgtagaccctgcctctgtgcatcaggcctcttttgagagtccctgcgtgccaggcggtgcacagaggtggagaagactcggctgtgccccagagcacctcctctcatcgaggaaaggacagacagtggctcccctgtggctgtggggacaagggcagagctccctggaacacaggagggagggaaggaagagaacatctcagaatctccctcctgatggcaaacgatccgggttaaattaaggtccggccttttcctgctcaggcatgtggagcttgtagtggaagaggctctctggaccctcatccaccacagtggcctggttagagaccttggggaaataactcacaggtgacccagggcctctgtcctgtaccgcagctgagggaaactgtcctgcgcttccactggggacaatgcgctccctcgtctccagactttccagtcctcattcggttctcgaaagtcgcctccagaagccccatcttgggaccaccgtgactttcattctccagggtgcctggccttggtgctgcccaagaccccagaggggccctcactggcctttcctgccttttctcccattgcccacccatgcacccccatcctgctccagcacccagactgccatccaggatctcctcaagtcacataacaagcagcacccacaaggtgctcccttccccctagcctgaatctgctgctccccgtctggggttccccgcccatgcacctctgggggcccctgggttctgccataccctgccctgtgtcccatggtggggaatgtccttctctccttatctcttcccttcccttaaatccaagttcagttgccatctcctccaggaagtcttcctggattcccctctctcttcttaaagcccctgtaaactctgaccacactgagcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagacgggagccccaggttatgacgtcaccatgctgggtggaggcagcacgtccaaatctactaaagggttaaaggagaaagggtgacttgacttttcttgagatattttgggggacgaagtgtggaaaagtggcagaggacacagtcacagcctcccttaaatgccaggaaagcctagaaaaattgtctgaaactaaacctcagccataacaaagaccaacacatgaatctccaggaaaaaagaaaaagaaaaatgtcatacagggtccatgcacaagagcctttaaaatgacccgctgaagggtgtcaggcctcctcctcctggactggcctgaaggctccacgagcttttgctgagacctttgggtccctgtggcctcatgtagtacccagtatgcagtaagtgctcaataaatgtttggctacaaaagaggcaaagctggcggagtctgaagaatccctcaaccgtgccggaacagatgctaacaccaaagggaaaagagcaggagccaagtcacgtttgggaacctgcagaggctgaaaactgccgcagattgctgcaaatcattgggggaaaaacggaaaacgtctgttttcccctttgtgcttttctctgttttcttctttgtgcttttctctgttttcaggatttgctacagtgaacatagattgctttggggccccaaatggaattattttgaaaggaaaatgcagataatcaggtggccgcactggagcaccagctgggtaggggtagagattgcaggcaaggaggaggagctgggtggggtgccaggcaggaagagcccgtaggccccgccgatcttgtgggagtcgtgggtggcagtgttccctccagactgtaaaagggagcacctggcgggaagagggaattcttttaaacatcattccagtgcccgagcctcctggacctgttgtcatcttgaggtgggcctcccctgggtgactctagtgtgcagcctggctgagactcagtggccctgggttcttactgctgacacctaccctcaacctcaaccactgcggcctcctgtgcaccctgatccagtggctcattttccactttcagtcccagctctatccctatttgcagtttccaagtgcctggtcctcagtcagctcagacccagccaggccagcccctggttcccacatcccctttgccaagctcatccccgccctgtttggcctgcgggagtgggagtgtgtccagacacagagacaaaggaccagcttttaaaacattttgttggggccaggtgtggtggctcacacctaatcccaacacctggggaggccaaggcagaaggatcacttgagtccaggagttcaagaccagcctgggcaacatagggagaccctgtctctacaattttttttttaattagctgggcctgttggcactctcctgtagttccagctactctagaggctgaggtgggaggactgcttgagcctgggaggtcagggctgcaatgagccatgttcacaccactgaacgccagcctgggcgagaccctgtatcaaaaaagtaaagtaaaatgaatcctgtacgttatattaaggtgccccaaattgtacttagaaggatttcatagttttaaatacttttgttatttaaaaaattaaatgactgcagcatataaattaggttcttaatggaggggaaaaagagtacaagaaaagaaataagaatctagaaacaaagataagagcagaaataaaccagaaaacacaaccttgcactcctaacttaaaaaaaaaaatgaagaaaacacaaccagtaaaacaacatataacagcattaagagctggctcctggctgggcgcggtggcgcatgcctgtaatcccaacactttgggaggccgatgctggaggatcacttgagaccaggagttcaaggttgcagtgagctatgatcataccactacaccctagcctgggcaacacagtgagactgagactctattaaaaaaaaaatgctggttccttccttatttcattcctttattcattcattcagacaacatttatggggcacttctgagcaccaggctctgtgctaagagcttttgcccccagggtccaggccaggggacaggggcaggtgagcagagaaacagggccagtcacagcagcaggaggaatgtaggatggagagcttggccaggcaaggacatgcagggggagcagcctgcacaagtcagcaagccagagaagacaggcagacccttgtttgggacctgttcagtggcctttgaaaggacagcccccacccggagtgctgggtgcaggagctgaaggaggatagtggaacactgcaacgtggagctcttcagagcaaaagcaaaataaacaactggaggcagctggggcagcagagggtgtgtgttcagcactaaggggtgtgaagcttgagcgctaggagagttcacactggcagaagagaggttggggcagctgcaagcctctggacatcgcccgacaggacagagggtggtggacggtggccctgaagagaggctcagttcagctggcagtggccgtgggagtgctgaagcaggcaggctgtcggcatctgctggggacggttaagcaggggtgagggcccagcctcagcagcccttcttggggggtcgctgggaaacatagaggagaactgaagaagcagggagtcccagggtccatgcagggcgagagagaagttgctcatgtggggcccaggctgcaggatcaggagaactggggaccctgtgactgccagcggggagaagggggtgtgcaggatcatgcccagggaagggcccaggggcccaagcatgggggggcctggttggctctgagaagatggagctaaagtcactttctcggaggatgtccaggccaatagttgggatgtgaagacgtgaagcagcacagagcctggaagcccaggatggacagaaacctacctgagcagtggggctttgaaagccttggggcggggggtgcaatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgtcgcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttatttatttattttgagacagagtctcactctgtcacccaggctggagtgcagtggtgcaatctcggctcactgcaacctccgcctcccaggttgaagcaactctcctgcctcagcctccctagtagctgggattacaagcacacaccaccatgcctagcaaatttttatatttttagtagaggaggagtgtcaccatgtttgccaagctggtctcaaactcctggcctcaggtgatctgcctaccttggtctcccaaagtgctgggattacaggtgtgagccaccacgcctgcccttaaaaatacattatatttaatagcaaagccccagttgtcactttaaaaagcatctatgtagaacatttatgtggaataaatacagtgaatttgtacgtggaatcgtttgcctctcctcaatcagggccagggatgcaggtgagcttgggctgagatgtcagaccccacagtaagtggggggcagagccaggctgggaccctcctctaggacagctctgtaactctgagaccctccaggcatcttttcctgtacctcagtgcttctgaaaaatctgtgtgaatcaaatcattttaaaggagcttgggttcatcactgtttaaaggacagtgtaaataattctgaaggtgactctaccctgttatttgatctcttctttggccagctgacttaacaggacatagacaggttttcctgtgtcagttcctaagctgatcaccttggacttgaagaggaggcttgtgtgggcatccagtgcccaccccgggttaaactcccagcagagtattgcactgggcttgctgagcctggtgaggcaaagcacagcacagcgagcaccaggcagtgctggagacaggccaagtctgggccagcctgggagccaactgtgaggcacggacggggctgtggggctgtggggctgcaggcttggggccagggagggagggctgggctctttggaacagccttgagagaactgaacccaaacaaaaccagatcaaggtctagtgagagcttagggctgctttgggtgctccaggaaattgattaaaccaagtggacacacacccccagccccacctcaccacagcctctccttcagggtcaaactctgaccacagacatttctcccctgactaggagttccctggatcaaaattgggagcttgcaacacatcgttctctcccttgatggtttttgtcagtgtctatccagagctgaagtgtaatatatatgttactgtagctgagaaattaaatttcaggattctgatttcataatgacaaccattcctcttttctctcccttctgtaaatctaagattctataaacggtgttgacttaatgtgacaattggcagtagttcaggtctgctttgtaaatacccttgtgtctattgtaaaatctcacaaaggcttgttgccttttttgtggggttagaacaagaaaaagccacatggaaaaaaaatttcttttttgtttttttgtttgcttgtttttttgagacagagtttcactctgtcgcccaggctggagtgcagtggtgcgatctccgcccactgcaagctccacctcccgggttcatgctattctcctgtctcagcctcccaagtagctgggactgcaggtgcccgccaccacacctggctaatttttttgtatttttagtagagacggggtttcaccgtgttagccaggatggtctcaatctcctgacctcgtcatctgcctgcctcggcctcccaaagtgctgagattacaggcgtgagccaccgtgcccggccagaaaaaaacatttctaagtatgtggcagatactgaattattgcttaatgtcctttgattcatttgtttaatttctttaatggattagtacagaaaacaaagttctcttccttgaaaaactggtaagttttctttgtcagataaggagagttaaataacccatgacatttccctttttgcctcggcttccaggaagctcaaagttaaatgtaatgatcactcttgtaattatcagtgttgatgcccttcccttcttctaatgttactctttacattttcctgctttattattgtgtgtgttttctaattctaagctgttcccactcctttctgaaagcaggcaaatcttctaagccttatccactgaaaagttatgaataaaaaatgatcgtcaagcctacaggtgctgaggctactccagaggctgaggccagaggaccacttgagcccaggaatttgagacctgggctgggcagcatagcaagactctatctccattaaaactatttttttttatttaaaaaataatccgcaaagaaggagtttatgtgggattccttaaaatcggagggtggcatgaattgattcaaagacttgtgcagagggcgacagtgactccttgagaagcagtgtgagaaagcctgtcccacctccttccgcagctccagcctgggctgaggcactgtcacagtgtctccttgctggcaggagagaatttcaacattcaccaaaaagtagtattgtttttattaggtttatgaggctgtagccttgaggacagcccaggacaactttgttgtcacatagatagcctgtggctacaaactctgagatctagattcttctgcggctgcttctgacctgagaaagttgcggaacctcagcgagcctcacatggcctccttgtccttaacgtggggacggtgggcaagaaaggtgatgtggcactagagatttatccatctctaaaggaggagtggattgtacattgaaacaccagagaaggaattacaaaggaagaatttgagtatctaaaaatgtaggtcaggcgctcctgtgttgattgcagggctattcacaatagccaagatttggaagcaacccaagtgtccatcaacagacaaatggataaagaaaatgtggtgcatatacacaatggaatactattcagccatgaaaaagaatgagaatctgtcatttgaaacaacatggatggaactggaggacattatgttaagtgaaataagccagacagaaggacagacttcacatgttctcacacatttgtgggagctaaaaattaaactcatggagatagagagtagaaggatggttaccagaggctgaggagggtggaggggagcagggagaaagtagggatggttaatgggtacaaaaacgtagttagcatgcatagatctagtattggatagcacagcagggtgacgacagccaacagtaatttatagtacatttaaaaacaactaaaagagtgtaactggactggctaacatggtgaaaccccgtctctactaaaaatacaaaaattagctgggcacggtggctcacgcctgtaatcccagcactttgggaggccgaggcgggccgatcacgaggtcaggagatcgagaccatcctagctaacatggtgaaaccccgtctctactacaaatacaaaaaaaagaaaaaattagccgggcatggtggtgggcgcctgtagtcccagctactcgggaggctgaggcaggagaatggcgtgaacccgggaggcggagcttgcagtgagccgagatcgcgccactgcactccagcctgggcgacaaggcaagattctatctcaaaaaaataaaaataaaataaaataaaataataaaataaaataaaataaaataaaataaaataaataaaataaaatgtataattggaatgtttataacacaagaaatgataaatgcttgaggtgatagataccccattcaccgtgatgtgattattgcacaatgtatgtctgtatctaaatatctcatgtaccccacaagtatatacacctactatgtacccatataaatttaaaattaaaaaattataaaacaaaaataaataagtaaattaaaatgtaggctggacaccgtggttcacgcctgtaatcccagtgctttgtgaggctgaggtgagagaatcacttgagcccaggagtttgagaccggcctgggtgacatagcgagaccccatcatcacaaagaatttttaaaaattagctgggcgtggtagcacataccggtagttccagctacttgggagaccgaggcaggaggattgcttgagcccaggagtttaaggctgcagtgagctacgatggcgccactgcattccagcctgggtgacagagtgagagcttgtctctattttaaaaataataaaaagaataaataaaaataaattaaaatgtaaatatgtgcatgttagaaaaaatacacccatcagcaaaaagggggtaaaggagcgatttcagtcataattggagagatgcagaataagccagcaatgcagtttcttttattttggtcaaaaaaaataagcaaaacaatgttgtaaacacccagtgctggcagcaatgtggtgaggctggctctctcaccagggctcacagggaaaactcatgcaacccttttagaaagccatgtggagagttgtaccgagaggttttagaatatttataactttgacccagaaattctattctaggactctgtgttatgaaaataacccatcatatggaaaaagctcctttcagaaagaggttcatgggaggctgtttgtattttttttttctttgcatcaaatccagctcctgcaggactgtttgtattattgaagtacaaagtggaatcaatacaaatgttggatagcaggggaacaatattcacaaaatggaatgggacatagtattaaacatagtgcttctgatgaccgtagaccatagacaatgcttaggatatgatatcacttcttttgttgttttttgtattttgagacgaagtctcattctgtcacccaggctggagttcagtggcgccatctcagctcactgcaacctccatctcccgggttcaagctattctccttcctcaacctcccgagtagctgggttgcgcaccaccatgcctggctaacttttgtatttttagtacagacggggtttcaccacgttggccaggctgctcttgaactcctgacgtcaggtgatccaccagccttgacctcccaaagtgctaggattacaggagccactgtacccagcctaggatatgatatcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaatgaaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcacaaagaaaaaaaacaaaacaaaaaacccaaagcacactgtttccactgtttccagagttcctgagaggaaaggtcaccgggtgaggaagacgttctcactgatctggcagagaaaatgtccagtttttccaactccctaaaccatggttttctatttcatagttcttaggcaaattggtaaaaatcatttctcatcaaaacgctgatattttcacacctccctggtgtctgcagaaagaaccttccagaaatgcagtcgtgggagacccatccaggccacccctgcttatggaagagctgagaaaaagccccacgggagcatttgctcagcttccgttacgcacctagtggcattgtgggtgggagagggctggtgggtggatggaaggagaaggcacagcccccccttgcagggacagagccctcgtacagaagggacaccccacatttgtcttccccacaaagcggcctgtgtcctgcctacggggtcagggcttctcaaacctggctgtgtgtcagaatcaccaggggaacttttcaaaactagagagactgaagccagactcctagattctaattctaggtcagggctaggggctgagattgtaaaaatccacaggtgattctgatgcccggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcgacctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgctgtggcttgaattattaggaagtggtgtgagtgcgtacacttgcgagacactgcatagaataaatccttcttgggctctcaggatctggctgcgacctctgggtgaatgtagcccggctccccacattcccccacacggtccactgttcccagaagccccttcctcatattctaggagggggtgtcccagcatttctgggtcccccagcctgcgcaggctgtgtggacagaatagggcagatgacggaccctctctccggaccctgcctgggaagctgagaatacccatcaaagtctccttccactcatgcccagccctgtccccaggagccccatagcccattggaagttgggctgaaggtggtggcacctgagactgggctgccgcctcctcccccgacacctgggcaggttgacgttgagtggctccactgtggacaggtgacccgtttgttctgatgagcggacaccaaggtcttactgtcctgctcagctgctgctcctacacgttcaaggcaggagccgattcctaagcctccagcttatgcttagcctgcgccaccctctggcagagactccagatgcaaagagccaaaccaaagtgcgacaggtccctctgcccagcgttgaggtgtggcagagaaatgctgcttttggcccttttagatttggctgcctcttgccaggagtggtggctcgtgcctgtaattccagcactttgggagactaaggcgggaggttcgcttgagcccaggagttcaagaccagcctgggcaacaatgagacccctgtgtctacaaaaagaattaaaattagccaggtgtggtggcacgcacctgtagtcccagctacttgggaggctgaggtgggaggattgcctgagtccgggaggcggaagttgcaaggagccatgatcgcgccactgcacttcaacctaggcaacagagtgagactttgtctcaaaaaacaatcatataataattttaaaataaatagatttggcttcctctaaatgtccccggggactccgtgcatcttctgtggagtgtctccgtgagattcgggactcagatcctcaagtgcaactgacccacccgataagctgaggcttcatcatcccctggccggtctatgtcgactgggcacccgaggctcctctcccaccagctctcttggtcagctgaaagcaaactgttaacaccctggggagctggacgtatgagacccttggggtgggaggcgttgatttttgagagcaatcacctggccctggctggcagtaccgggacactgctgtggctccggggtgggctgtctccagaaaatgcctggcctgaggcagccacccgcatccagcccagagggtttattcttgcaatgtgctgctgcttcctgccctgagcacctggatcccggcttctgccctgaggccccttgagtcccacaggtagcaagcgcttgccctgcggctgctgcatggggctaactaacgcttcctcaccagtgtctgctaagtgtctcctctgtctcccacgccctgctctcctgtccccccagtttgtctgctgtgaggggacagaagaggtgtgtgccgcccccacccctgcccgggcccttgttcctgggattgctgttttcagctgtttgagctttgatcctggttctctggcttcctcaaagtgagctcggccagaggaggaaggccatgtgctttctggttgaagtcaagtctggtgccctggtggaggctgtgctgctgaggcggagctggggagagagtgcacacgggctgcgtggccaacccctctgggtagctgatgcccaaagacgctgcagtgcccaggacatctgggacctccctggggcccgcccgtgtgtcccgcgctgtgttcatctgcgggctagcctgtgacccgcgctgtgctcgtctgcgggctagcctgtgtcccgcgctctgcttgtctgcggtctagcctgtgacctggcagagagccaccagatgtcccgggctgagcactgccctctgagcaccttcacaggaagcccttctcctggtgagaagagatgccagcccctggcatctgggggcactggatccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagccgacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagaggcctgcctccaagggacctgtctgtctgccactgtggagtccctacagcgtgccccccacaggggagctggttctttgactgagatcagctggcagctcagggtcatcattcccagagggagcggtgccctggaggccacaggcctcctcatgtgtgtctgcgtccgctcgagcttactgagacactaaatctgttggtttctgctgtgccacctacccaccctgttggtgttgctttgttcctattgctaaagacaggaatgtccaggacactgagtgtgcaggtgcctgctggttctcacgtccgagctgctgaactccgctgggtcctgcttactgatggtctttgctctagtgctttccagggtccgtggaagcttttcctggaataaagcccacgcatcgaccctcacagcgcctcccctctttgaggcccagcagataccccactcctgcctttccagcaagatttttcagatgctgtgcatactcatcatattgatcacttttttcttcatgcctgattgtgatctgtcaatttcatgtcaggaaagggagtgacatttttacacttaagcgtttgctgagcaaatgtctgggtcttgcacaatgacaatgggtccctgtttttcccagaggctcttttgttctgcagggattgaagacactccagtcccacagtccccagctcccctggggcagggttggcagaatttcgacaacacatttttccaccctgactaggatgtgctcctcatggcagctgggaaccactgtccaataagggcctgggcttacacagctgcttctcattgagttacacccttaataaaataatcccattttatcctttttgtctctctgtcttcctctctctctgcctttcctcttctctctcctcctctctcatctccaggtgcaaatagtctacaaaccagttgacctgagcaaggtgacctccaagtgtggctcattaggcaacatccatcataaaccaggtagccctgtggaaggtgagggttgggacgggagggtgcagggggtggaggagtcctggtgaggctggaactgctccagacttcagaaggggctggaaaggatattttaggtagacctacatcaaggaaagtgttgagtgtgaaacttgcgggagcccaggaggcgtggtggctccagctcgctcctgcccaggccatgctgcccaagacaaggtgaggcgggagtgaagtgaaataaggcaggcacagaaagaaagcacatattctcggccgggcgctgtggctcacgcctgtaattccagcactttgggaggccaaggtgggtggatcatgaggtcaggagattgagaccatcctggctaacacagtgaaaccccgtctctactaaaaatacaaaaaattagccgggcgtggtggtgggcgcctgtagtcccagctactccggaggctgaggcaggaaaatggcgtgaacccggaaggcggagcttgcagtgagcggagtgagcagagatcgcgccactgcactccagcctgggcgacagagcgagactccgtctcaaaaaaaaaaagcacatgttctcgcttctttgtgggatccaggagatagagaatagaaggatggttaccagaggctgggaagggtagtgaggggatggtggggggatggtcaatgggtacaaaaaaaatagaataagacctagtatttgatagtgcaacagggtgactatagtcaataataatttaattgtacatttaaaaataactaaaagatagccgggtgcagtggcttacgtctgtaatcccagtactttgggaggctgaggtgggcgtttgagaccagcctggccaacatggtgaaaccccatctctactaaaaatacaaaaattagccaggcatggtggcgggcgcctgtaatcccagctactcgggaggctgaggcaggagaatcacttgaacctgggaggcagaggttgcagtgagccgagatcttgccactgcactccagcctgggtgacagtgaaactccgtctcaaaaataaaaataaaaatacagctgggcacggtggctcacgcctgtaatcccagcactttgggaggccgaggcgagcggatcacaaggtcaggagatatagaccatcctggctaacacggtgaaacccggtctctactaaaaatacaaaaaattagccaggcgtggtggcaggtgcctatagtcccagctactcacaaggctgaggcaggagaatggcatgaacctgggaggcggagcttgcagtgagccgagattgtgccactgcactccagcctgggcgagagagtgagactccgtctcaaaacaaaaacaaaaacaaaaacaaaaacaaacacacaacaaaaacctaaaagaatataaatggattgtttgtaacacaaaggacaaatgtttgaggggatggataccccattttccatgatgtgattattatacattgtgtgtctgtatcaaaacatctcatgagccccataaatatatacacctaactatgtacccacaaaaattaaaaaaatatattttttaaggtgaagagggaggcgagatgctggccttaacccctaacccgttgttctccctgcaagctgtccacagggcctctcagactcgaggttcagctatatggatgcatgagcttggtccccagccaacatgggagacacttcaccatcggcagcagctacagcacaggaaccctgggtcactgccatgtcccctctgtgactttgtttaaacagaaaatgatgctctgggccggctgtggtggcccacacctataatcccagcaccttgggaggcgggggtgggcagattgcctgaggtcaggagttggagatcagcctggccgacatggcgaaaccccatgtctactaaaaatacaaaaactagccaggcatggtggcacatgcctgtaatcccagctacttgggaggctgaagcaggagaatcacttgaacccaggaggcagaggctgagtgagccaagatcgtgccaatgcactccagcttgggtgagggagtgagactccgtctcaaaaaaaaaaaaaaagaaagaaaaagaaaagaaagtgatcctactggaaccatgcttactcccctccccacctcacactgtgtagaaattagtgctgtcggccaggcgcggtggctcatgcctgtaatcgcagcactttgggaggccaaggcaggcggatcacgaggtcaggagatcaagaccatcctggctaacacagtgaaaccctgtctctactaaaaatacaaaaaattagccgggcatggtggcaggcacctgtagtcccaactacttgggaggctgaggcaggagaatggcatgaacctgggaggcggagcttgcagtgagccaagatcgcgccactgcataccagcctaggtgacagagtgagactcagcaaaaaaagaaagaaagaaagaaagaaatcagtgctgtctatacttctttctgcagtgatggaaatattctgtatctgtgctgtccagtatagtagccactagctacatgtggcacttgaaacatggctggtacagttgaggaagagtggctgccatatcggacgacacagctatagattctgtcaccccaccccgagagtccagagcggggacttctgccttaggccctattcagggctgatttttacttgaacccttactgtgggaagagaaggccatgagaagttcagtctagaatgtgactccttattttctggctcccttggacactttgtgggatttagtctccctgtggaaagtattccacaagtggtgccactaccccagctgtgagagcagctgggagctgcttttgtcatctttccctggaaagtcctgtgggctgtctcttcctcatgccttgtcccatgcttgggcatggtgtcaagcgtcaggagggagaaagggtccttatttatttatttagagagggacccttcttctgttcccaggctggagtgcagtggtgcgatctcggctcactgcaacctccgcctcctgggttcaagtgattctcctgcctcagcctcctgagtagctgagattacaggcacatgccaacatgcccggctaattttttttttttttttttttttttttttttttttttttttgagatggagttgtactctcattgcccaggctggaatgtaatggcacaatctcggctcactgcaacctccacctcctggattcaagcaattctcctgtctcagcttcccaagtagctgggattacaggtgcccgccaccatgctcaactaatttttgtattttttttttagtagagacgaggtttcaccatgttggtcagactggtctcaaactcctgacctcaggtgatccacctgcctcggcctcccaaagtgctaggattacaggcatgagccaccacgcccggcctgaaagggttcttatttagtgtgcattttgacattcaatttaattccaaggtcttgtggggtcatggtttacaggatgttgatatagaaaagacttcacttaatgggccgggcgcagtggctcatgcctgtaatcccagcactttgggaggccgaggcaggcagatcaggaggtcaggagattgagaccatcctggctaacacagtgaaaccccatctctactgaaaatacaaaaaattagctgggcgtggtggcaggcacctgtagtcccagccactcggttggctgaggcaggagaatggcatgaacccgggaggcggagcttgcagtgagcagagaccatgccactgcactccagcctgggcgacagagcaagactctgtctcaagaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttcaaggacagagtccagtcgaagattgggtccctggacaatatcacccacgtccctggcggaggaaataaaaaggtaaagggggtagggtgggttggatgctgcccttgggtatatgggcattaatcaagttgagtggacaaaggctggtccagttcccagaggaggaaaacagaggcttctgtgttgactggctggatgtgggccctcagcagcatccagtgggtctccactgcctgtctcaatcacctggagctttagcacgtttcacacctgggccccaacctggagaggctgaccaatgggtctcaggggcagctcggttgctggagtttttgtttttatttatttttatgtatttaaggcagggtctctgtattagtccattctcacactgctaataaagacatacccaagactgggtaatttataaaggaaagaggtttaatggactcacagttccacatggctggggaggcctcaaaatcatggcggaaggcaaaggagaagcaaaggcatttcttacatggcgacaggcaagagagcgtgtgcaggggaactcccatttataaaaccatcagacctcatgagatttattcactatcatgagaacagcatgggaaagacccgcccccatgattcagttacctcccactgggtccctcccatgacacatggaattatgggagctacaattcaagatgagatttgggtggggacacagccaaaccatatcagtctccctctgtcatccaggctggagtgcactggcatgatctcggctcactgcagcctctacctccctgggtcaggtgatcttcccacctcagcctcccaggtagctggaactacaggtacctgccactatgcctggctaaatattttgtatttcctgtggagacgaggttttgccacgttgcccaggctggtcttgaactcctgaggtcaagcaatatgcccacctcggcctcccaaggtgctgggattacaggtgtgagccacagtgctcggcctaagtcactgcagtttttaaagctcccaggtgattcttcagtgcagtcaaaagtgagaactggctgggtgcggtggctcatgcctgtaatcccagcaccttgggaggcgaaggtgggcagatggcttgaggtcaggagttcaagaccagcctggccaacatggtaaaaccccatctctactaaaaatacaaaagttagctgggtgtggtggtgcgtgcctgtaatcccagctacttgggaggctgaggcatgagaattgcttgaacccaggggacagaggttgtagtgagccgagatcgtgccactgcactccagcctgggcaacagagtgagattccatctcacaaaaaaaaaaaaaagcgagaaccactgtcctaggccctgatgtttgcaggcaactaaaaaaggaagtggacatccccagtcagctgtggcgcaccaagaacaagtcatgggaacataacctaattttctaaatgggttactaggcacttagagcaaaacaatgatgccgaaatcctgatttcagcaaagcctctgcctgcctgtcttggaagtatccacatgaggctgctggggccttggtgtccccagcagtttctagtctctaggtcttgctgtgggtgtctgtgcagtgagggtgtgtgtggcgctgggtgagctctgtctaggcctggcacaggatgcggtctggtagctgctgcttctcttctgcagaagcgcagccaagcaccctctggggtttcaggcccacacccagcctgaagttctgggagtggctcactttccaaccttcagggtctcccagcagctgactggggagtggtggagggaaaagggattgtattagtccgttttcacgccgctgatgaagacatacccgatactgggcagtctaaaagatagaggtctgatggactcacagttccacgtgactggggaggcctgacaatcatggtggaaggtgaaaggcttgtctcacacggtggcagacaagagaaaagagcttgtgcaggggaactcccctttataaaaccatcagatctcgggagacttattcactatcatgagaacagcacgggaaagaccctcctctatgattcaattacctcccaccaggtccctcccacaacatgtaggaattgtgggaactacaattcaagatgacatttgggtggggacacagccaaaccatatcagggcgtcccagaaagggtatagggtctgagacccaagtcagcatgagaaagtatgcttctcatggtggcccagttgggtggaagtggcagccgggccgtctttccaccaggccactcaagtagcagctgagagacccctgccctggccagtccccgccctcccctcttgccactgcctctggttctgaacagatgggcaccctcatcttgtatttgtgattaatgtctaacaatgtagttttgtgagaagggtttgctgatacagccttgctgcagatgctgcgaactgtggcctggggcagaccttacctccagacacgccctgaggcaggggagggcactggcccgtagctggccgagagctctcgggttgcgcgacagggatacttttcagcggctgggtcgctatccaaagtgagaaaacgaggagggaccaggaggctgtccgcctcaagagatgtgggggccaggtccagttatctggggaagcagtaagcttctctgctgtttctaaccccaggcctcccctggtctaaggcagggcctcccagcctcggggcactttaaagatatctgggcctggccccatccccacagtctgactgagtgggtctggatagggcctgagcattggtgatttcctgggtgaaaggaggcccctcacagtctctggaagcttctctgtgttaggaaaagctctgggcttgactctgctttgaaagtcaagatccgcaaatcctctcagcctcagtttctccttcagcaagatgaaatggaaatgctgtacctacgtcccggggtggttgtgagacccaaaaaagacaatgttctggaaggttcctggtgcgttgcagtcctctaagaacctgagttagagccacgctgagtctcagcttcttggctccttctgtttcaaactcgtccatgtgatagctcaggaagggtaggcagggccctgccccctactcagaaaacaccatcctggtcctggggatccccgcagcattagtcccctgttttcccagtgtattgagaaaaattgctaacaagcagtggggcacaccaccagcctcctgggttcctttcagtttggggatttttggacattcccaggaatgtcttaaaaaacacttcaaaaaacattaacataaatatttttatcaaagcctgtattaaatggtctttcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagccgagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccagatgctcaaagagcctaggacccaaaaagggctgagaatgaccgtgtcggccacttcagggtcatcaggaattgctgtgcactgctcacttctccagtgaacactttctgcttctgtgtttcctggtatcctttgggactcctggctaggtcatgtgtttctctactttcaaaagggcttcagccaggcacgatggcatgagcctgtagtcccagttgctctggaggttaaggtgggaagattgcttgagcccaggaatttgaggccagcctgggcaagtagataggtagatgattgatagatagatagatagataaatagatggatagataagtcgctagacagtcatccatccacccatccacacataaaaaggcctttgtcatgtcatgttttgtggcccacctgccagtgttgcccacagttgctgcccctccaaactcatcagtcactggcaaacaggaggaatgtgtggctcatgtctgggcatcagtggctgtgggagacatccttgatcttctccagcttctccttccacattttcctttgcaatctggcaatatctattaaaataaaatgtgcatgccttttgacctaagagcttcacttctaggacccacttacacgtgtgtgacatgatgttcatacgggtttatttatctgaggttgttcatacacaccattgcctgtaatcactaaaggcgggagcagcctacacatccatccacagaggagtagatgccttttggtacatccgtggcgacggaatactaagcagcctgtgtatctatacactcacacgtgtttgtttatgtgtggaatatctctggagggtacacaagaaacttaaaatgatcactgtctctggggagggtacctgggtgcctgggaggcaggtcagggaaggagtgggcacaggtattaccaattggaagacaataaaaacaacagctcctggccaggcgcagtggctcacgcctgtaatggcagcactctgagaggctgaggcgggcagattgcttgcgtccaggagttcaagaccagcctgggcaacatagcaaaaccccgtttctattaaaaatacaaaaaattagccaggtgtggtggcatgcacctgtaatcccagctactcgggaggctgaggtgggagaatcacctgagcctgggaggtcaaggctgcagtgaggtgagattgtgccaccgcactctagcctgggcgatagagcaagaccctgtctcaaaaacaaacaaaaaacagtccctggcactctgggccaggcctggcagggcagttggcagggctggtctttctctggcacttcatctcaccctccctcccttcctcttcttgcagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattc

SEQ ID NO: 36505 - DNA, 4142 bp, Homo sapiens
gctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggtacgcgggatcctggggcggtccgggccggcaggcgggttagggggcagccgggcactgaggggtcgatccgggcgaggagggcggcggggccggcctccctgcagcggccaggccgggcttgggggtcccatcgggggcgcggggaggaggcctcccggtgcgcacgccccttccctcctgggccgtggaaagcgccggggtcggccccagatgaccttggacgattccctgctcctcccttggcctcagccttttccgcagcaaaggcccatccgtgggtgcggcgttttgcggccaggggcccccatgttttgggaggctttgcgcaggaagatgcacctaagtaatagtttcgccaccgctgggttgatgtagttcattcaaaccagaaacttgaggtttgagtggtatggctgcaaataaacacgtggctttctaaggctctttgaagaatttaaagtaacttgcaaatcttatcaatacggaccccttgaggtctgagaaccctggactgggaccaaggagctaggtaatttccggccctagtgattaccagcctgagcttatggcacccaccagtcccccagttgtcctgcccctctggtttctgcagccccttccattccaggactgacaagtctgttttaattgggggtgggggctaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaaggtatcgtgagagggtggcacagacccaggggctggaagtttcagggcccctgtgttttgttcctggtgtattttgggagtttggtaaattgtcaaaagtgtgtttgtccaggtgcaaggtccatgccaggctagttgcccctcctcagtaggttccggctggtgtgagggccagctgtggacactgttctctatctctgcagaaaacgttgaagatccaggatgtcgggcttgtgccgatgggtggtgtgatgtctggggctgtccctgctgcagcagcccaggaggtgagtcctgggcagaatgaggcatttctggggtgcccagttcgcctgtggcctcatgtgccgtggtcccgtatctcaggttctgcagctaccgtcattgtctgcagcctgcacacctgtgcggcatcctgcagcctcctgggacctactccctgccacggatgtgcacgactttgcatgtggagaccatgtttctaatggagggaaacagacactaagctgagagaggaaaaagaggctgggcgtggtggctcacgcctgtaatcccagcgcttcgggaggccgagacgggtggatcacttgaggtcaggagttcgaggccagcctggccaacatggtaaaaccccgtctctactaaaaatacaaaaaaaaaaaaattagctgggcctggtggcacatgcctgtaatcccagctactcgggaggctgaggcaggagaatagcttgaacccgggagactgtctcaaacaaacaaacaaaataaataaataaaaataaaaataaataaataaataaaaatacaaaaattagccggcgtggtggcaggtgcctgtaatcccagctacttgggaggctgaggcaagagaattgcttgaaccagggaggcggaggttgcagtgagccaagatcatactactgccttccaacttggcaacagagcaagaccctgtctcaaaaaaaaaaaaaaaaaaaaaagaggaaaaagaaaggaagaaattataccaaatagaacattgtaagcattgtggggaaaaggagggaagaggctcaaggtgggagggagagttccaagttcaaggtgggcttcaaagaggaggcagacattgtagaagagagcacggccttcctggcggaggacggggaggcaccaaggtcaccaggcaagagggtgtctgacaattcagggagcagcagcgaggtacaggctggcgcaggcgaaggggtgtaacaagcagctccgtccttgggtctttgcaaggaaaccagtgaacttgaagccgccagttgcgtttggtcatcgggttgcgtgaacctctccaccggagccctcccctcagcccctttcccccactggggaaccaggttgtgtactgtagagtgtcccatgttccagatgcgtggggtgcccatggggcagcatcactcatgcctgagaactggaaggtagtttaaaggctgattagattcaggccgagcgtttgggtaagaatagctgggattactgtagagcctgttgtgtaaactggattgcttttgaggagggagaagatgttattaatagccttcccaggccgtggggacacgcagccccctgccctcgggtggtgctgggtctccatgcgccacgtcagaagcgcagcgtgcccgtcagtcccatggcgggttgtcattttctcggcacacgtgcactgcagtgtggctgagaaaggaatggcgctgcttttatctacaaagcacttttggtgtcgttctttcctgtctcataagttacgctttctaagcgagaggggagtagagtattgagggaaggactgtgaagcatgtttttatttatttatgaaaccgagtctcactctgtcacccaggctggagtgcaatggcgcgatctcagcccccgcctcccgggttcaagcaattctcatgccgcagcctcccgagtagctgggattacaggcgcgcaccactagagacagggtttcaccatattggtcaggctggtttcaaacttgacctcaagtgatccacccgccttggcctcccaaagcgctaggatgacaggcgtgagccaccggagccaccactcccgtccgaggcatgttacaaagagttattgggcagacctgcctctgactagcatgagagaaaaagcaccagctggactcgcgaggccaaggcaggagaatcgcttgaacccaggaggtggaggttgcagtgagctgaggtcgcaccactgcactccagcctggatgacagagtgagactccgtctcaaaaaaaagagaaaagaaaagaaaaagcaccagctggttaaggattgatgagttgggagacgtgacttccaactccaggcttcgctggggcctccgctgcacctccctttggggctttagactggggtggcccagcagtggaggcgttagctccccccagccctttgtcacctggctccccttctttcctgctccctaaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggtctgtgccgcggtgggggttccgaggcaggttccgttgtggtggccagggcccccagtccctgactttgctctctctggcaggcaaagaagctggtggagtccctgccccaggaaatcaaagccaatgtcgccaaagctgaggcggagaagatcaaggcggccctggaggcggtgggcggcaccgtggttctggagtagcctccagctcggaggacttgtgttcaggggtcctgggccccgggcgaggtcccgccctcccgtggtcactggctccgcccccagcaccaggcgcccagtggagccgtttgggagaattgcctgcgccacgcagcggggccggacaggccgcacagacctactgtggcgggagggaggggcggctgctgcctggtgacggcacccggaggcccaccaggacgcgccaccggtgaatgtgcctctggtggctgctgagaaaaatacactgtgcagctcag

SEQ ID NO: 36506 - DNA, 11677 bp, Homo sapiens
cgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccctgatatctctccacaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccaggttagttctctgccctctgagactcgtcgagtgcatgggggatcctcagcacacagatggagcccagaacggggatgggggcagcagtgtgggtgaaatagtcctgggccctaaggacctggaggctgcagctgagtgaagcctttccgcttctcacaaaaggagaatcaaagtgtcccaaaactcaggagtaggagcctcttctctgagggtaaacctgtttttgttgttgttgttgttgttgttgttgtttttccccccaataaggtccttacactgctgcaatttttttttaagacaagttcttgctctgtcacacaggctagcatgcagtggcacaatcttggctcactgcaacctcctcctcccaggttcaagcaattctcatacctcagcctcccgaaggctaggactacaggcacacgccaccacacccggctaatttttgtatttttagtagagatggggatttcaccttgttgaccaggctgttctcgaactcctgacctcaagtgatccacctgcctcagccttccaaagtgctaggattacaggcgtgagccaccatacccggccagcaatttttagacattgaaaacaaccataacatatggagggtggtgtggataagtgactctctacacttggtgttcctgtatgctgtagccatcccttcctgtgcaggggattttccacaggacagagctgtggaaattccctatagacacacactcacaattcattcaacaaatggtcaagaagcatatcgtatgttcaaaacactgttctaccaagggtaaatcattgaacaaattatattaagaactcttccctcaaaaagtgattagttagctaaccatatattctatcagatggtaatgaacatctataggaaacattaagcaaggaaggaataaagaggcaatgtgagacattgcaattcttaacagaatggtcagggaagacttcactgtaaagatgggaattgagccatcccatctgatggcaaggagtcatcagatgcttaaggactgaacaacccagctacaggaagagcatatgcaaagggcctggggaaggaacatctctggcagtttccaggacccccagaaggtgatgctggtgtggctgaaatggagtgagtgcaggaagtgaaaggagatgaattcacagaggcaatgaaaacacattaaacatggcattgtaagccacaaacagtctttggtttttagggcgagtgacgtggaaagcgttggaaggttttgagctaagaagtatcatgatcacactagggctggtctgttgaaaatagactacagaaggtaagggcagaataagaaggagggcaccgcagtattccaggcgtgagtgatggtagcttgaggcagggtggtggctgtgccgactcagcatgacgggttagctttattcatcctggtccttcccatggtgactggtttgctacctctgggccttggccctggaagccattgaggtgtcagccaggtgtgagccagcatcactttctccatctgagttttctgagggagaaagcaggagagcaggtggctgaggagctcttcaagtgtgctcctaggggcactcttaccccagatgttctgtttcaaactaagtggatatttctggctgccttttcagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaaggtaaaagaggctgagtatggtggctcatggcttgaatcccagcactgtgggaggctgaggcaggcagatcacttgagccctggagttcgagaccagcctgggcgataaagtgagaccctgtttaattaaaaaaaaaaagaaaagaaaaagagtagaaggacagttcaccaccatagaaaggacacagctctcccaggtaccagcatacagaagagagaggaaatgcacagcagcagcaaggacttggaactctcatgtccttggaatgaatctctcagagctttcattctttcactctgcccaccttgcattcattcatctggctacataaagtactaaatggttgagcaaaagcaagtgtaacaatgtgctggtactacccagccacctgatcatacataatttctggtttctgacagtgccctaggcatgagggaagggagatgttgctgttcatagaaaggacggttcctgcattgtttactaaaaacccaacttcttttagttcttctgtcaaagacatgattttctttgtttgtttttcagagaaacttcaagaagaattgcgtaagtttagcctttccttaactacatgtacaatttgagttctgctcagcaacatctcatgacattcgtctctgtctgtcccttgcaggatggagaagaacattcttacatgctggtgagtgcctctgatgttccctcagatctcagctttctccacactagccagctaacaggactccttagaggagatgagcaaggggcccagggcaaggtggggacagcagggaacgggggtcagttcatcaacagtgtcccagcaatgatgcatcatgtctcttctgtcagggaatcccagcagctctcaatccaccctatggtttacatcccaggatcctttatcttttggagtaatttaatgcatgattaccagaggtgtcccatatatagtagccttcctaagagttacatttcagtagttgttgttctttgatcctggatgaatttgaaaaaagacaatgctatcttagcagcttatatcctggggatggtgtagactgtgccaagttgaagacccatgtagggaagaggccaggagggtccctagtaagcctgacataagggtgtaccaataggtggccagaaatgcctttctgctcttaagagaacactaatactttgtgtatagcctgccgtgggagggatttcaggtgggtgggagagcacagaacccaattgcccactcccagtgagcacttttcatcttatgattcagcccctctgcccataagcaccacagaatccaagctttaccagataccatggcacatggacctttcctctttaggtgaatttcaaaattgccactgtcaacttgggacaaaatagcaaattgtcacagccagacatattaacttggggaatggaggaaatcattttaacacaatagaaaagtagactgaataagtaagaataaatacagatgggagaggtctgcagaatgcccggagtctggagcatttcttgtacctacagaagtgatatgtgaagacatcagacccatgttgttgaagcaaaactggatgggaatagttactccctacatttgcccacagacccctcaggcaacaggttttcttttggggacatttattctccttcttcattttttgaagggtgcccttgttagtcatttaagtcagttgtgatctggtaaaaggaacacataggaccaatgaagagaccctttatcctccaggacagtgtgaagggaaagactcaccttagttgatccaccggggagaggaggagcaggacataaagcctttgtgctggtttaagccaagttggaaagtttctaagtaaagaaaatcccagagatcataggtcttcatttggggttttgttttgttttgttttgagatgatgtcttgctctgtcacccaggctggagtgccatggcacaatctgggctcactgcaacctctgcctcccgggttcaagcaattctcgtgcctcagcctcctgagtagctgggattacaggtgtgcaccaccatgcccggctaatttttgtatttttagtagagatggggtttcaccatgttgtccaggctggtctcgaactcctgacctcaggtgatccacctgcctcagcctcccaaagttctgggattacaggcgtgagtcaccacgcctggccagagatcatatgtcttggatagaaaagggaacacatcttagaatgctgagagaaagtataagaatgattgattttacttcatttgctaaactttccggatttcttagagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 36507 - DNA, 36918 bp, Homo sapiens
ctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctggtaagaagccggcggagtcggcctggggagggggcggttgctaagggactgagagaggcgttgccgggggtggggccgggccaatctgggcccgcaggtggcagcgggtggggcctggggaccgcagccagggctctcgaagcgtctaccctgcttcacgtgcctaagtctggggtcttttctcataacccctcctggaatctgagggagaatccaggccagctccagtaaatcccacccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcacccctgaaaggttttttttgagggctggttcctatttgataatggctccagatgatttagaagctagccactgatttcagtaaatacttctgcctccttccactcctaaccactaaaaaaggctccctctgcggatctgtttttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttcttgatatcaaatatctactgtccagattttccagttttcttgtaaatgtcatatgtattttaactttatttgaattaggttccaaaagtccttttttatttgtttgataaatctgttaaatctcttttaatctgtagcttcttccttcatcttttttttttttttgtaagttatttgacaacataattaggacctgggattttctactgtctagattttgccatttggagccgtttgtatagtttaatatgctactctgatgggactgctttgaatgaaccaaaaagcactgtatccactgctgtgttttgttctatttctttttttttcttttttttaaatttgagatggagtctcactcttagtgcccaggttggagtgcaatggctcgatctcagctcactgcaacctccaccccaccctaggttcaagcggttcttctgccccagcctcccgagtagatgggattacaggcgcccaccaccatgcccggctaatttttgtatttttagtagagatagggtttcaccatgttggccaggctggtctcgaactcctgacctcaggtgatactgcttcggtctcccagagtgctgggattacaggtatgagccactatacctggccattttcttctgtttcgtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttcttgtcattgtttgagacagagtctcactctgtcgcccaggctggaatgcagtggtacggtcttggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggccatattcatgtacatttcatgggttaatgttcttttgatattggtcattgatatttctcaaccatcttcaagaatgagcttcttgagagcacttgctttgtgtaagaacaaattcaggcacttaaacagaaaagtctggattttatttattcaataaataaatcaacttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttcctgtctcaggaagagttcattgcacatatttgactctttatttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttagtcatagcaaaggagaagtaacagtatctggttttaataatagctcatatattccattggtacatatttacaaagggccaaactcaactaatttatttaaaaaaaaaagaagcgtggcacagtggctcacgcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggaggctgaggcaggtggatcacttgagcccaggacttcataccagcctgggcaacatggcgagactccatctcaacaacaaatacgaaaaaattaacgaggtgtggtggctaacctgtggtcccccctactcaggagatcgaagcaggtgaattgcttgagcccaggagacggaggttgcagagagctgtgatcacgccactgcactccagcctgggtgacagagcgagaccctgacaaaaaaaaaagggattctggtgttctagcgttgcggttgtttctaaatgcccttcttagcagttttattgcactataattggcatactattcagttcacccatgtagagtgtacaattcaatggggttttaaaaattagtatattcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgggattacagacgtgagccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggcaccactcgcggaacactgctaacaccgatatgtggaggttgtttccccactactcaggaggctgaggtgggaggatggcttaagcccaggagttggaggttgcagtgaaccgagattatgccactgcactccatgctgggtgacagagaaagaccccatctcaaaaaaaaaaagtagtaggttgtcacctgcatttctcagcagctggcagtgaattgaaggttcacaggactccctccttgagtttggttaacttgctagagcgggtcagaaaacacagaaatgctacttacatttgctagtttattaataaaggatatcataaaggatacagaagaacagccagatggagagattcaaggaacgtgggagggggcacggagctttcatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgtcccaaccgttgtttgttcactgtcccatacaatttccaaagagaatcattcacaagatgatatctgcttcccagatccattcattccccactaagaattatttcctcccacatccctatctccccttcccctgtgaagaagagtatagaagcgtctgtacctcgctggcattattgggtaatcattctgcagttcccctgtgcaatgcatgttaaataagtggatgcctttgctcccattaatctgccttttgtcggttcactttcagcagacctttagagagtgaaaggggaagcttttcctcttggccgctacaatacatatgtaggtgcatatatgtttaatcacttatggatgagtctagtttctaaaagtacttttttcatcactgtgtttcttttctgatcagtaaaaaagattttttttttttttttgagaccgagtctcactctgtcgcctaggctggagtgcagtagcacaatctcggctcactgcagcctctgcctcctgggttcaagcgattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttcccattatgaatgctgacgtacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtttggctgacttgaaactattgtctgggagtgtggctgccacccagccaatgtccagctgatgtgggtaggaacaggttgtgggaaggagagctgatggccgaccattatttttctttgttgccaaactgctgcgtcttttttttttttttttttgagagtgtctcactttgttgcccaggctggagtgcagtggcatgatcttggctggctcactgcaacctccgcctcctaggttcaagcagctctcctgccctagcctcccgagtagctgggattacaggcgtgctccaccactcccagctaacttgtatttttagtagagatggggtttcaccatcttgcctaggctggtctcgaacttctggcctcaagtgatcctcctgcctcagcctcccaaagtgctgggattacaggtgtgagccactgcacccagcccagactgctgcttctctaacaagacaactaaaatgatttcctttgaattgtttctctaaatgtctgtggcatacctgcaagttgcttgcaggatttctgtgttttgtgatgcatgttgtaaaggatgctgcttcagatgtagaagttttaggagccgagagccaagctgaatctgtgcctcttcctaacataaagtggaagttggccaggcgcagtggctcatgcctgtaatcccagcactttgggaggctgaggagggcggatcacgaggtcaggagatcgagaccatcctggctaacacggtgaaatcccgtctctactaaaaatacaaaaaaattagccgggcgtgttggcaggcgcctgtagtcccagctactcaggaggctgaggcaggagaatggtgtgaacccgggaggcggagcttgcagtgagctgagattgcgccactgcactccagcctgggcgacagagcgagactccgtctcaaaaaaaaaaaaaaaaaagtggaagttgcttttaaaaatactttccatgttagtttgtcttgtgactaacctcatttccatagacactaactacaaaagataattataactaattgacattctaaattaatttggttctggctaactgaaacttttgttcatatctaatggagtaagtttcataaggctgatgatagctgaaggtctttaaatattttgccaaaacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgcctggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccccagtaaacatctttacaccttgttttttgaaccttttcatgcgatacaggcagacctcactttatgcgctttgctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgcaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctgtgtgaacagaaaggtcgaagatatgaggcggtgaagtggatggtggtgtttgccattggagtctgcactggcctggtgaggaggcagggcctggagggatggtgggccatagggctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggactctaggcaggcatgagatcgctctttagggaaaaagcgaagtcgtgggtacggaactgtgaacatcgtgcccttcatttagcacagcgtgccagtgaacagggtggcacaccatagctattgatctcatgcagggagtttatggtgctatcctgggctcctccccgtacgtcgttaatgttatctagaagatagagccagcagctgtgagtgaagggatatgcccgtatgaacagagttggtggaggcagcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgttcggtataatatagccacaggggccaaccacaatttttattttcatggcatgcatcaaatttttactatagtaaatccacaagtaaaggaacatcttactaggtaagactgatggcattcagaagccctcttcagtgatattctgatggataccattttggggaaacttgggttgatttattgttttatttaaatctcagggtgttgggccagggacggtggctcacacctgtaatcccagcattttgagaggccgagacaggaggactgcttgagcccaggagtttgagaccagcctgggcaacgtagggagaccctgtctccttaaaaataaaaaaaaaattaaaaaaaagaaatctcagggtatttattttgctatatatgtttctggttgcagatttctctataataagcatagtccttaggcctctagttgttagtgtttgtgctacttttatatcaaactctttggagctgccacttgtcagtactacaggttgagtgttccttatcagaaaatccaaaatgctccaaaatccaaaactttttgaatgctgacacgattctcaggaaatactcattggcgcattcagattttggatttcaaatttttggatttgggatgtttaatcagtataatgtagatattcgaaaaaaaaatctgaaatccaaaacacttctggtcccaagcatttcagataagtgttactcaagctgaagcaactttacctcctacctttgtattttaggaaggcacacctgcctttatgacatagcactcccaactcttgtccattgatgtgtggccactttatggcttcagtatcaaaaagcctccaggcattggcttgagggaaggccagagttaaaggcaagaagctttgatcctgaatccataaaattagaagtctttctagttctcctttaagccctgagcactttggagagtggaatactggaatttggttgttttctctacccagagtaactatggactataagatggttataagtcaagcctggcacagtggggtgtgcctgtaatcccagctacctgggaggctgaggcaggaggatctcttaaaccctggagttcaaggccagcctaggcaatatagcaagaccccatctcaaaaaaagatgatttcaagtcaaaataatgacttacaaaatagaacctgctaataaggaacatgcaaaaagcacatacacctaaatgaatgttgtgttttaaagcaagcttgtccaacccatggcccaacacagattcatataccttttaaaaacatttatgagatttttctgagtttttcttttcttagctcatcagctgtcattagtgtattttatgtgtggccaaagacaattcttcttccagtgtggtccagggaagccaaaagagtagacacccctgtgtcagtagtctttcttggtctcacatctttttctgcacctgcttccctctttgttttccgttgcttcactcaacttagctgtactctctgcctttgttctttggaggggcagtgggactgggctggagaagggatctcctccttctgcgcttttctgctgtgcattcacgtactgctggctggtgagcagcctccgtatgtgcagtgggggaggagatgccttcaagaggagcacacctgtactatacttgtgctacacttggaaataaggctgtgtgacagatctcttgctcttcacaggtgggtctctttgtggacttttttgtgcgactcttcacccaactcaagttcggagtggtacagacatgtatccttttcacggttcctggtgttcgtggacttcagtggtcaccaagattctttcttacatagaaatgggtctaacagtaagcatagtattagaagggccgcttattagctattcagctttaatatttctaatgatcactgaaggacacaaaagaaggactttaataagcaaagacatatacctatgtttgtggttgataagattacagatgccgcaaagatgcctgtactccctaatctgtaaatttaatgtagttccaatcaaaattccaatagaatttgttgtggaactcagaaattctttgtaaatttgtgtagaagagtaaagggccaaaagcagtcagtatagttctaaatgacaagaaggtggacttgaccctgtcagatatcaagtcttataaaattaacaagtttggggagttagggaaaaaaaagtcataaaatttaagatacagtcattgaaattggtcatattggtgcaggaatacctagacagtggaaaatgatagagaagcagaagctggtcctcacatacatggaactttggtgaatgacagttaatattacaaatcagtgagggagtgatgaatgatttaataaaagacgctgtgttatttaataaataaaagatacacatctctgtagtcccagctacttaggaggtgagcccaggagtttgaggctgtaatgcaccatgactgtgcctgggcagcatagcaagaccctgtcttaaaaaaaatgatgctgggacatgggtgatccatatggaaaaatagttatattcctatttcatactataaataagataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccgtctcaaaaacaaacaaacaaaaacatcaatggctgggtgcagtggctcatgcctgtaatctcaggactttgggaggccgaggcaggcagatcacctgaggtcaggagttcaaggccagcctggctaacatgacaaaaccccatctctactaaaagtacaaaaaattagctgggcatggtggcgggtgcctgtaatcccagctacttggaaggctgaggtgggagaatcgcttgaacccgggagacagaggctgcagtgagccgagatcgcgccattgcactccagcctgggcaatgagagcaaaactgtctcaaaaaacaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccagaatacaggaagaggctgggcgcggtggctgacgcctgtaatcccagcactttgggaggccgaggcaggcggatcacttgaggtcaggagttcaagaccagcctggccaacatggtgaaaccctgtctctactaaaaatacaaattgagctgagtgtggtggtgtgcacctttagtccagatacttgggaggcagaggcaggagaatcacttgaacccaggaggcggaggttgcagtgagccgagattgcaacactgtactccagcctgggtgacagaatgagactctgattcagaacaaataatacaggaagaactcctgcaactcaatcagaaaaacaacagatggtccaatggaaggaaaacgagcaaaggatgtgaactggaattctcaaaagagaaaaactggccagtaaacctctagaaaaaggaaggtgcacattcctgtgactcatacattcctcttagaaatttgaaccgtagacatgtacaaaggtggtaattatagctttatgatagcaaaaagctggagtcaccaaatgggagaatggaaaaattatggtacattcatatggtatcattttagacatcatgtcatttctgtagattgtaaaataaaaattttagacaagtgaaagtgaacgaaccacagagttgtgtgtatcaacatggctaattctcaaagacttaatgttgagaaaaaaagagcaagttacagaatatacaagtgccgtgtacaacagtgtggacacttttgaaatacacacaataatttcaggttagtggtttctcccaggggagagaggaaggaaaactgtttttttttttgttttgttttgtttcttaaaatggtactgaatgttttcttttttaaaaatacctggagcatatatggcatgttgttgagatttgttaaagctacagttgtgagggtatgggtattcgttactttttgtaatgtttgaagtatttcctaatgtcaaaggcatctcaaacaattttttcttttttttaagagatgaggcctcacactgttgcctaggctggaatgcagtggtgcaatgacagctcactgcagcctcagcctcccaggctcaagcgatcctcccacctcagcttcttgagtagctgggaccataggcatataccttttgtactttttgtagcgacatggtctcactacattgcccaggctggcctccaactcttaggctcaagtgatcctcctgcctcagcctcccaaagtgttgggattacaggcatgagccattgcacccagtcatctcaggcagtttttaaaaaatttttatatatagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaacctcacctttgtcttcctggcaagcctccttgttctcattgaggtgaggtggtttggattcacctgctcgcttaggaggttttagagtcccgcactccttttccccacctccttccagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtagagaaaccctgtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctacctcaaaaaaaaaaaagaaaaaaaagtgcaagtcctcccattgcccctcagacctcctgagtcagatcctctggagtggggcccagcagctgtggttctgcaagccctccaggtgacgctcacgctgctaatgaaggtggccagctctccctcttccgccgcccagattgttgagggtaagccagagaaccaatggatttcgagttatgggtgtgcctgctctcctccatcagccggtggcagcaggttccgggatacccgaggtcaaatgctatctgaatggcgtaaaggtgccaggaatcgtccgtctccggaccctgctctgcaaggtccttggagtgctgttcagtgtggctggaggtaagaagggtccaacttgtatccttcaaatactcaaagggcagagacgacaagaagcatgatgtatttcagttattagatttggactgcagggcccagcctcaaacagctgatgtctgcactttttgttgatgggctgtttttaaatgcagacactgttcgtatgttaccattcagatacctgacaaacacactcttcagttttgggatttggaatttagcttgtggaattagcttttgtcaaaattagcaagctttttgtgtcaacagccagatagtaaatatttaaggctttgtgggccaagaatcagaatggaagctcttatgtagatgtttatgtaactatttacatgtgtgcatttaagaacgtaaaagccagtcttagttctcaggccgtgtaaaaccaggagggagctggtggtctgggctcacaggctctcatttgctgacacacaatttagaatgtagagtgttttctcttctagcaagacttgaaatggagcttatttggtgggaatttggctctttctcttataaagtcttaggatcatctctgttcagttgtcacgaggaaggtttttgtagccaaggtctcctgacccaggggcgtttctgcactgactgttggtctttcctttttcaccctgcccagggctcttcgtggagaaggaaggccccatgatccacagtggttcggtggtgggagctggcctccctcaggtaagatgggctgagagggtgtgggcctctgggcaggcctagtgggaggtctggttacactgggccaaatccattgggacaccctgacatcacattggaacctggtgccattctggcttcacgtgtaaaccatgtgtctatctctcaggaaagggcataacttatacttggaagttttaatgatgccctaccgagccctaggagcaaaaatgagacatagagaaaaactgtgacgtggcggatgaaagtcactgggtgcttccatagccatcaccaggcgcctctatatagggtggctgggtggatcatctcagtgctgccagatccaagaggctcgaagcatcgactgacatggttttaggcacagttccgtgctgattctagttggcgtggtacagtcataataactgctgctaattatggtctgtgtgccagacgccatgtatactaactgctttctccttatagccaccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaagattctttcgtccagagctcgtcttttggtctctctcctgctactgccttgagcaccagatctggcagaagtgagccaaggggtggaaggccaggcgtggagtgggcatcagtgtgcacctttgtggggcagacagaggacaggctctgggcccttctcttcctggcgctgctgagcagagcagactcggtcttctgcaacagcttccgcgtccccttccctcagctcagccatttgcctttattctttcagacttgttgactctgcacaaaatgggatttcagaaggtcctagaaacacgagggcaggaaaaataagctcctcccaagggtggggggtaatctccttttttcccaagtttttttattttcattttttgagacggagtctcactctgttgcccaggctggagtgcgatggtgccatctctgctcactacagcctccgcctcctgggttcaagcgattctcctggctcagcctcctgagtagctgggattacaggcatatgtcaccacgcctggctaaattttgtatttttagtagagacagggttttgccacgttggccaggttggtctccaactcctgaccttaggtaatcagccgtccgcctcggcctcccaaagtggtgggattacaggcgtgagccatgagctaccacgcccagcctccttttttcccaagttgctgttctggactttccttcctgcagcacacttacccaggtgtgctcaagcagaggggcctcccctgatgccgtggattcccatagtttcagtcctaggctgcccctgacctgtgttcttttttttttttccataattactggggtacaggtagtatttggttatatgagtaggctctttagtggctctcttttctcttgctttagtttcagagcatctccttacggaagatccagtttaacttcccctatttccgaagcgacaggtatggaaaggttagaaattggtttcttttttggaaacaacatgttcatgcgctgcgggtcagactcgacacttgctctagcctggcagtatcccctgcggggaaacccgactgggagaagggggcgggctttgaacttttcttctggaaataagaagccaaagcaccaggctggcatcgtgacttttattttgtcatgccgtaaggcctagaagcatctcaggcaaatgaagatggtcccagattaaaaacccaaccaagaaaggccacagacaggcatattcttaggaaggcgttttgtattccccagtgattcacttggtcagccaccctcctgggtcagaaggtactcttagtagacttcttagccctgtatcagatgtgtgtgttactgacctgccggcctcgtaaggctctttcaatcagagactcagtttagagtcacggaccaccttctttttgtattcctgcaagttcggcacatacccagaaggcaccttgatgtttttactgatgccggggttttctggaaggaagatccggtgggaacatggtgcagcagtgatcgtgccgatctttgatctgccccctgagctgggggctgagattctgagatcacagaaaacacagaggtcaggggctcctgttcccaggcagagtagccgccatgctgaaagggactctggtgctaaggtgtgtggctctcgggtggacacactcgcggcaaaggctgcctcaccagtgacctgcccttccaggatccctgcctattcattcacaggtgtgagaaaatgttcatgataaggaagtcagaaaccaccttttgggggctgggggctctttattggataacccgtctctctcctctcctcagagacaagagagactttgtatcagcaggagcggctgctggagttgctgcagctttcggggcgccaatcgggggtaccttgttcagtctagaggagggttcgtccttctggaaccaagggctcacgtggaaagtggtgaggaggaccttcagtgaaagcattaaccacaccccccgaattacactgggtgtcccttactcggtacatggaatggtagttttgatgagactggggggtcaactggatcagaaacagctttcctcttgtgcccataacctccacactggactttctgtacttctcatatcaataccctccctaaccccaaatcaaaccgctgttactttttttttttttttttttttttgagatggagtcttgctctgttgcccaggctggagggcagtgacgcgatctcggcttactgcagcctctgcctcctggattcaagcgattctcctgcctcagccttatgagtagctgggattataggcacgtgccaccgcatccagctaatttttgtatttttagtagagatggggcttctgacatcaggtgatccacccgccttggcttcccaaagtgttgggattacaggcgtgagccaccacgcctggccttgttatcctttcttgatgaaccacctgacatgaaaatgtgaaactggctgttgtcataaagcaggaagtgatggggcttggactggagccggtcttctccctcagagcaggctgtccttccctttgcattgatccttccttttggtgcaaggtctggtctgtaaaggctgtaaataggctctcatagtagagtaggctgctggaacggaaacttcttaaagcccaatctagagttggtcatacctggggtgtatctactgtaagggtgactagatctctgtacccggatgtagattccggaggtctctgcgtagagcagtgggtaccaggaggaagggttgggagagagtaggacatgccactcctgaaccttcttgtcttttgtcacctctcccctagctcttttgttccatgtctgccaccttcaccctcaacttcttccgttctgggattcagtttggaagctggggttccttccagctccctggattgctgaactttggcgagtttaaggtatgttttgtcctttccccaaggatttttaatttgacccatgaaaatttcctctcaagtgaaggaccagagagaaatgagcagagggctaggtacaacttccagggacacatctcacccattagcctctgccgtgcgggaaagcagccccactcttgcttctgtcttctcttctgtctcttccggttctcatggctgctatggtttttctctccctctccctttccccttctctcagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcaggtatctgcacagtcgcctcccccccgagcctgctgcggctccctgagcttggtgtgggccgcgccatctctcccgaggagcggaccctgcctccacggctttgatttctcatctaagactgagaatctaaacacggccatgcatcttccctacttgacaggccaaagggctgagccagcttaattgatgtcagagttgctggttgactccctgcctgtcctgacttggccactcggacacatgacaaggttagaagggtcaccgtggccctgccgagcagcttgctctcaggaggcttctcgccccaggacttattataatggaaagccattcattccttggagagagatgatgtggacgtagcagcccactttaactgtccactttttacaaacaaattgctggaatacagcaaatcacggatcaattctgcacacatgttgactgaccaggggctgctgtgaatgctgtttggagaaatcggggctgggggtaggcagggttatgttttgaatttctgagaccagagcttctttctgtggcgttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatatgttgggttcatccttccacacccattacctgagcgttgagagatatgggaatctgtagtcgtctttttacctcagagaaagtgcacaccacatgccctgtgtctttgccacttctgtgaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcatcacagaggggaacctgggaacgaccctggcgtcacagaggggaacctgggaacgacactggcgtcacagaggggaacctgggaacaaccctggcatcacagagggcaactcctctctgttgaacaacactcatgggaaacagacacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcagacaggtgagcattctctaagtgcggtcggccatccacatttgtgggtcctgcatccatggaattacgtagggtcaaccaactgtggagcaaatatattcaggatgcaaaacataaaaaagaacaagacaacagtaaaaaataatgcaaataaaaaacagtacagtgtaacaattatttacatagcatttacattgtattagggtattataaataatctagagatgatttaaaagtatataggaggacctacataggttatatgcaaatatacaccattttatatctgggacttgagcatccctggattttggtatccatcgggatcctggaccctatccctggtgaatactgaggaacaactgtactctttccttgttgcttctctgtaaccacttgaatctctcagatccccattggggcccttgtcttggaggacagcctcttcagtgtccccagttatatgtatatattatatatatatatatatatatatatatacacacacacactatatatacacacacacacacacacacacacacacacaaacacacattatatatttctgtttgttttgtttttttaagacggagtcttactctgttacccaggccggagtgcagtggcgcgatcttggcccactgcaacttccgcctcccaagttcaagtgattctcctgcctcagcctcccgagtaactgggattacaggcacccaccaccatgcccagctaattttgtatttttagtagagatggtgtttcaccatgttggccaggctggtctcgaactcctgacctcaagtgatccacccatctcggcctcccaaattgctaggattacaggtgtgtcaccacgcccagcctggtttatatatatatgtttttgtttttgtttttgtttttgtttttggcaaagtctcactctgttgcccaagctggagtggagtggcaagatctcggctcactgcaaactccacctcctgggttcaagcgattctcctgcctcagcctcccaagtagctgggacttcaggcacgcaccaccattcccagataatttttgtatttctagtagagacggagtttcactattttggctgggcttgttttgaactcctgaccttgtgatccgcccacctcggcctcccaaagtgctaggattgcaggcgtgagccaccgtgtccagctggtttatatatttttaaagggttgagagaaaaaaaagaatatgccgcagagactgtacatcactggcaacttctaaaatatttactgtctggctctttatgaaaaagtttgccgacccctgttactagttattcccaagcctagctcattaccagacagataccttgatgcgtgtgatttaaagcatacaaaaaacgattctgtggtcaaatgggctaggaattaaatatgcttctttatctttttagagacaggatctcactctgtcacccaggctggagtacggtggtgtgatcatagcttattgtaacctcaaactcctgggctcaagcgatcctcccatctcagcctcccaagtagctgggactacaggtgcatgccaccacatccagcttatttttatagagacaggatctcactatgttgcccaggctggtctcgaacttctggcctaaaatgatctcctgttttaggagtgctaggattatagacacaagccatagcacccaacctaaatacgttcctttagtacagaacttctagggccttattcccataagtgttataaatgtttggtgtctttattgtgtaccagatattccactgagtactttatatgatttcatttaatccttatcagcactgtgcttgctggccagtagctgtgcccccattttacagctaaggaagctgaggcacagtatggtcttgaccaaaaaccttcagctagtcatatatagtgagagggtaggtgttgttaccattttataggtgaggaaactcacaaaatgaaatatccttctcaacgtcactagagagtggcagagtttagagacaaagccatctgattttggagcctgtgctcagcttttagcagacacactgatttccaagaattgctaggatgtttctcagtgcagttgaccacaggactctctggaaagccttcaggactgaacttcctccagacagtttgggaaacactgcatgtgtctattatgaagccatcagctgagctcatcccccgtgcactccacaacgctgaggctctgcacatggctcaccagtgccaggtgctgccagtcagcagtgccgtgctgtttgcacagcagcctgcatacgtctatattgcccagcccgtttcacctggcggggtcacacaaaccaccccctggtattgttagcacgtccacataatggcatctccacagctgtgtcatccagaagaaacccatagccttgattaacctttgtaataagactccctatttgcatgcacagtgataggtgtgaagtacaaccttgtaccgttgtacactgtcaactagaaaataaaacagcacacttgaaacacccttgccttctagcaaagatcccatcttcccacacagaatgatggcaagaaaatgaggtctaaaatgtgtagaagtagtagaagaaataatctctttttctgtttgggttttgttccccagatggggtctagaaggagaggcagcctggaggactgggtctgctctccaggcattatggaggtgggttttcttttgcagcaaattcaggtgctttttttttttttgtagcaaattgcagcaaaatcaaaggctttttctatttggaaccagagttggggctttcggtcaagtggtgccctggattttcctccccagatacctgtcaactcccagtcacttgctctcacctgcctcatattcccccagtcctagggctctcaggccaggcttctagcagcatcacttagaaagttagcaccgggagaggaagcagaaccaaattcacggtgaatcacggccatagtgacattttcatcatgagtgtggatgaacaaaaggccctcatcccgattctttcatctgtgcattcagaatgtgaagaatacacttgcccgtgtggctgccgttggtagaggtcagtttttggcctgtttgattgatggggaaagctgtgcagccacctgttttggacccggctggagacatcccacttgaagactcaaagtcaggtgtccttgtactgattttctgattccttcttctcaggtcacagaagatgtgaattcaagtatcaagacatttttttgtcccaatgatacctacaatgacatggccacactcttcttcaacccgcaggagtctgccatcctccagctcttccaccaggatggtgagtgtctgcactgcagcccaatcgtgggtgattggtgtcatctcggacacagccaggcttgcccttcattccaagcaagaccaggacttctttgtaacgcccacccagacaaaagattggtttctgcctcctgtgttggaaggggaactggtatggggtgtggtcgggcccggtaggtctactgggccttggcaggcatccggtagtgggactcaggttggctcttcccttgcaggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaaggtactctgtgtgtgtgcgtgtgtgtgcgcatgtgcatgtgtgtgcacgtgtgcgtgtgtatgcatgtgtgtgcgtgtgcgtgcgttgatgtgtctgtgcccatgcatgcacatatgtgcataggcacaagagtatgagctgtaggtcctccccacagcctatcagtgtggttcaaagccatgttctcggtgttttccttcactagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtgagcacactccctccaggcccctgtcaggctcagggccacgtccgccccacaggacctatttttaggtctttgctttgtgtttcaggtggccaaatggacaggggactttttcaataagggcatttatgatatccacgtgggcctgcgaggcgtgccgcttctggaatgggagacagaggtggaaatggacaagtaaggccatgattttgctcatgtcctagtttcagaatgtataagctctgaggcctaaggaatgttgttattagggtaggaaacagtaactcacttttcttgggctgaaagaagcaacacacccattcctgagcatgtgtgagaatgtggagcagcccatgggctgggggctgcgggggcagggcaggggacacgggcactgtgggactgcagtgggcagggcctcttcgtggtggtttgactcccatggcattctggttagatatgaggtgaggtctctggatcaagttcgtgatgtgattgaatgtttaagggtatgccaagccccaggagtgagaatagcctgtttcacatgtgcccaccagaatgccctactgccagccgggattgttctgggcataatcacctcataacccacctgctaatccacaggtacctgggcttcctgtgtctagatagcaggcaaggcccttacgggctaacacgggggccagcaagccgtttctgtggagggccagacaggagtttattttcaactttccgggctgtatggtctctgtcacgactactcgactctgtcattgcagcaggaaagcagtaagcgtgacggacttgatcagtgggctacagtttgctgtgccctgatctaaagggggacccaagtgctgtgtttattttattattattgtttttcttttttgggacaggatctcactctgtcgcctaggctggagtagggtggcatgattatagctcactgcaacctatgcctcccaggctcaagcgatcctccacctcagcctcctgagtagctgggatcacaggcgcgtgccaccacacctggctaatttttaacattttttttatagaaatggggttttgctgtgttgcccaggctggttttgaactcctgggctcaagcaatctgctggcctcggcctcccaaagtgctgggattacatgcgtgagccgctgcacccagcccacccatttacccagttgtggtaaatgctgtagcagaattagcagttcaggggtagtatgtggagcgtgctgcagggcaccgaggagggcgtggccagcccctggaccagcagccagggcttcctggtgaggggatgttgctgttgagctgagggatgagcccgagcccatcagcctggtacagcagggtacgacattccaggtgcgggaacagcatgtgtcgggggatagaagtacaaaggaatgcatcgggtttgagggagagctggggcagttcagaagagccccccaccccgcccgtggtctgagcagggctggagagccagcacagcttgctcccaggggcctgcgggcactgtcatgaggctggatgacttgccctcctcccccaggctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaaggtaaagaaaacggcatgagaggaaaggcaggtgagagacaagcggtcccgtctcacacggcttagtgctttgcccacccctggctggggtggacttaccggctctcaggggaagttggcactgttctcatcacatgcgacagggagagtagatttgacagcaggggcagctttatcaggccgtgaagatgtgtgtgcgttcttgccgcaatgagcatgtggacagatctgtttttcaagtcagcagctttcatggtttgtttaccatgtgagagtatcagggagagttctagagatgccagcaacagaaatggacttcgacctccttaagaaagagaaagaaatccacaggaaagctcaggacagctgggaaagctgaaggaccagaaccatgtgctgtggggagcagtgcagggtctagcagacatcccttgggtaccaggaggaaggagcactggccctgggttcctcctgattccgattcagaatccagggagagggggtatcctgttgcctcacttgggtcatgtgccactccttggctttgggggcaggcacgttgattgaaaattctatcaagacaggatgtaggagatggcttgttcccctctggagaatcaagctgctcttcccagattaaaggaaaccacagaagctgcagccaggtcctagggttcaggctcatttgaaccaccagcctgagccactcttttgaacctcagccccattaagttcctgcgtccggatgtgcttctgaccctccctgtcacccaaatccttaagctccatcagtactgctgtgttcgtttgcccatgcgcagtagcctgtggcctccccacccacagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggaggtgagagcctggcggggcccccactgcccgcagggctacacagcggtggggtgagcctttggctcagatgttgtgaggtggctcctgagtttcctgggaaagttggatggggagcgggctgggaacatggatcagaagcgctcccgctgagggtatcccaggcagcatctggtttttgtgtaacagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcggtaagtctctccgaggcagaaatcagccaggccagacctgacgaagctcgaggggttgggcgctgccggcgggccgtgaacagtgccatagggaaagctgaatgcaaggcgagaagtgcagagtggacttaggggaggagtcgccacagccgggtggtgagaagcaacagcggtttattccttcatagttcaaggccagaagtacaaaatccgggtgtcaccagggcagcgctccctggctctggtgctgtccttgccccttcctagctcatgggagttgcctgcagaccttggtgctcctgactgtgaacacagcccccatcctcgccactgtcatcacacggcgttctcctgtgtatcttctctcctttccctaaggacgcttgtcaccggatttggggcccgccctaatccagcatgggttcatctgaactcggtcacatctgtagagaccttgtttccagaaaggtcgcattcataggtactagggcttaggacttggccatatcttttggtggggggacacattcaccccccagccactttacttagtgctttctcacttaaacttcctaataagccatttgcatctcatgaatcaggaagaaagggagtgcagacagatcaggggacttgcccagggtgccacagctaggacttggccaaggacttggtttgactggagagctctcactctggagcgcttgctgctgctgcaccacctgcctcagcagcctggagctgggcatattcaggcatcaaggggaggggctctaaggtgaccctgctggccactgctgcctgagcacggacagtgtctgggttggaattgcagagcgccagccagccgcgcctctcctatgccgagatggccgaggactacccgcggtaccccgacatccacgacctggacctgacgctgctcaacccgcgcatgatcgtggtgagaagggctgccccggcctgtcccatgcggagctgcctcttcatgccgttggcgtctcaggcagtcagtgacacgtggtctctttgcaggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattattgctgcagactttccttttttcttctttttagaacttcattattttcttattacacaaatattttcttattacacaaatatgatttcattgtaggaaaatacaaaaacacatatgagcaaaaaacaagcaaaaaccaaaccctcgtccctaccctgtcgcggtagccctggtaacttttcaaggccaccctctcagtcttttgttgttgttgctgttgttgttgttttgagacagggtctcactctgtcacccaggctggagtgcagtggcaagatctcggctcactgcagcctcgaccttccaggctcaagcagtcctcccacctcagcctcctgagtagctgggaccacaggcatgcgccactatgcccagctagtttttgtatttatggtagagacacggtttcgccatgttgcccaggctggtcttgaactcctgaactcaagtgattcacctgcctcggcctcccaaagtgctgggattacatgcgtcagccactgcacccggcctcagtcttttcttctatgcggcacaaccctggcatgcatagtgcgtacttacacaggttttgttgcagtaggttaacttatgtcccttgaaatgtaattgccaactacactgacagagtcctaacatagtttatgacgtggctttggagttcccaacaacagtgacacgtgggaaccactgtaacgacctgtaacaaatgactcccataggtcactttgcaaggtggtgagtatgaggcatggcaggggtcataatctcaggagacttcaagggccccaccgcttgcacatctgtgaagcaggctggtcatgatgggagctgagcgctgagcatgtgccctgtggaaggacattttagttcagatgccagctggcccaagccctttttggagctaaccttgtccccttggcctccagtgtgtgagccctcgttagctgtttatcccaatcaagctgtgtctggctgtgcactatccaggcctccacattctgtgacaaactaacagggccggctcctgtcactcctgttctcgccagcgggttttaccctgaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtc

SEQ ID NO: 36508 - DNA, 11560 bp, Homo sapiens
ggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaaggtagggctggagggcctccctggcctggcccacacgtcctgccaggccagagccctgagcttggggtcccttgaaccccctcctgcctatcctatgtgacttggaaactgagaggggaaaagggagtgatatgggataggggctgcctgtctccccctgaacatcccggagcccccagctatggttggggctggaatgggggggcacacagccacacataaacagagggggtcagtccattgcaaagatacccacctgatcagtcttctgttaacccttcgtgttcttggggggaacaacatagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccaggtaaagcaggtacagcgctcggaccctggactcaccccccatacaccaggatgggctcagcttctcccagctggagaactttaagtttccagcccactggaatcgccccaacagtattgccgagggaggagttcctgccccatttgacagaggggaacactgaggctcagggtggcttttcccagggtcccatggtgaggaagtgggggactgggttggaacctgggtcgagggatctcggggctggaggagggggctggtggggggcgggtcctcgggcgagagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggccaggtgagggggccgcccctcccacctccccccactcacccgggagaagaagaggcagcccggtcccctaggggctgggagcctggctgggcttgggcggagggttctggagaaatgggagtggagtgggggaggggggggacagtggagagagggaaaagcagggaggtggggggagaggcagacagagatactgggagcctgagacaccctagggacagacgggggagggcgagccaggagcgagataagacctagacaaggatggaggggcagggagaggagacagagccccaccacccccaccccaggcaggaaacctggagacagagaaagacctagagaggcagatatacaagacccaggagccctacccctggccagacagggactagccacctagagagatggggacccaagactgggccaagaaaagacagcgctggggaagagagagacagaggagtcggggggataagagggagagagacatacagacgtgcaaggggtgggggctaagacagagacaagcccccaccactaaccagagacagagccctggagctgaagacctgggggacacggagagacagagatgtatgaccagcactcctctgcaagccagcacccagggacacctccttagacatccttcttcccttcctgaggtgccctctcttccaacagggggcacagagggggcagggctagaggaagagaagccccaagtttggcctgggcgaaaaaccagggtgccgggtgccacccctctagctcagaggatccagctccccacaccccacccctcatctacattccctggtgccaaacctcagaatgcccggaatggccccctgggcaggtgccacctcagccctggctctcagcccgccccagcccccatcccccaactatggatctggggcaaaattgccttagttgggaaggacgagggagatcaggctctaggaagttcagacaggacccagggagcccaggctgcccccaatgcatcctcacccctttctctgtgccccctgccctcccctcgccccagctggcccagaagtatgaccaccagcgggagcaggagctgagagagtggatcgagggggtgacaggccgtcgcatcggcaacaacttcatggacggcctcaaagatggcatcattctttgcgagtgagtgaggctctcgaagccgagaccctgcaacatcccccaactccatgcagcccctcaacccccaaaacaaccatgatcctggaactgagttgaacactttctattggatacctttggggtggccagtaatcattgtgcccatttaacaggcacagaaaactgaggctcaggtgaaatgcattgcaccaagtcccacgtggtttcaagggaaatgactctagaatcttaaccaccatgctatatagggtaggcccatctgtggccgccagagtccccagaaagagcggtcacagctaaaaggcagcagccaacagctgttcatggctggcttggtgatgtgaggagagatgtgcagcaataattaaaggaggccctggttttctttctgttttctttttgtttttttgagatacagtcttgttctgttgcccaggctgcagtgcagagacacaatctcggctcactgcaacctccgcctccagggtttaagtgattctcctgcctcagcctccccaatagctgggattacaggcacgcaccaccatgcctggctaatttttgtatttttttaaagtagagatggggtttcaccatgttggccaggatggttacgaactcctgacctcaattgatccacctacctcagcctcccaaagtgctgggattacaggcacgtgccaccatgcccggttaatttttgttttttttttttttttttcagtagagatggagtttcaccatgttgactaggctggtcttgaactcctgacttcaagtgatccacctgccttggcctcccaaagtgctgggattgcaggcacatgccaccacgcctggctaatttttgtattttttttttttttttttagtagagacagtgtttcaccatgttgaccgggctggtctcaaactcctgacctcaagtgatccacctgcctcggcctcccaaattgctgggattacaggcatgagccacctcgcccgaccttcttcttcttcttcttttttttgagatggagtcttcctctgtcacccgggctggagtgcagtgacatgatctcagctcactgcaacctctgctttccgggttcaagtgattcttgtgtctcagcctcctgagcagctgggattacaggtgcccaccaccttgcccggataacttttgtatttttagtagagacgggattttgccatgttggcctggctggtctcgaactcctgacctcaagtgatccacccgccttagtctcacaaagtgctggcattacaggcatgaaccactgcaccctgccggccctggttttctcctcgcctcaaaacctcattgctgagggaggtgaaaaccctaacagctcccaagccccagttccactgcaatcttttttttttttttcagatggaatcttgctttgtgacccaggctggagtgcagtggcatgatcttggctcactgcaagctctgcctcccaggttcaagcaattctcctgcctcagcctcctgagtagctgggattacaggtgcccgccaccacgcccagctaatttttgtatttttagtagagacggggtttcaccatgttggtcaggctggtctcgaacccctgaccttgtgatccacccacctcggcctcccaaagtgctgggattataggcgtgagccaccgcgcccggctccactgcaatcttaatgcatagcagggccctaaacccagcctgcgcccgatctgcatttgagtctgacccagggcagagtgactgtgagtggcctcgggaagactttgaaggtgcagcttcatcaagtcctagatgctgggaagaaggggtgtggggggtgtttaccttgttccattcccatccactaggaacaaggaattggcaggtggggaggtaggcatgctggtgtcccagctcaggcagaggactgctcagacgtcaaacagtgcagtcccagcctgggcaacatagccagattccatctctacaaaacatttttgttttaattagcttggcatggtggcatgcgcctgtggtcccagctactcggaaggctgaggtgggaggatcgcttgagccctggaggtcaaggctgcagtgagctatgatcgcgccactgcactccagcctgggcaacagtgaaaccctgtctcaaaaaaaaaaaaactaatgtaaacgacaagttgatgggtgcagcaaaccaacatggcacatgtatacctatgtatcaaacctgcacgttgtgcatgtgtaccctagaacttaaagtataataataataataataataataataaaagagtgggccgggcgcggtgactcacgtctgtaatcccagcactttgggaggctgaggcaggcggatcacgaggtcaggagatcaagaccatcctggctaacacggtgaaaccctgtctctactaaaaaaaatacaaaaaattagccgggcgtggtggcaggcgcttgtagtcccagctactcgggaggctgaggcaggagaatagcgtgaacccgggaggcggagcttgcagtgagccgagatcccaccactgcactccagcttgggtgacagagcgagactccgtctcaaaaaaaaaaaaaaaaaaaaagacctaatgtaaatgacgagttgatgggtgcagcaaaccaaaatggcacatgtatacctatgtatcaaacctgcacatagtgcacatgtaccccagaagttaaagtataagaaaaaaaaaaagagtgtagtgcagtcacccacgcactccggtcattcactcattcattcattcattcattcacaaaagaagcatttatgagttcctgctgtgtgccaggctctggcctaggcactgggaacagtgaacagaacagactcgactcagagctcaaggacttttagtccagttgaggagatcaatcatataattgatcaaataatcacagatttgtggtcgtaagtgtcctggggaaaactcaagcggaagggaagatgggagggtcaggtatatgtctgcgggtggagagtctgcagtttcctagagagtggtctgggaggcctctctgaagaggtgacatttgaacagaaccttagatgaagtgagggagggctcaggggacctgaggcaaagcagagggggccaccagtgcaaaggcgtgaggtaggatcgtgcttggggtgttcaagaaacaagaaggaggctggcgtgacgagcaccaaatgattgagcagaagtggagatgaagtcgcagagtgaactgagagtcagatggtggagggcattttatttcatttatttatttagagacagagtcttgctctggtgcccgggctggagtacagcggtgcaatcatagctcactacagcctcgacttcctaggctcaactgatcctcccaccccagcctcttcagccccagcctcctcagtagctggaactacaggcacacatcaccacgcccggtgaagttttcgggttttttttttttttttttttgtagagacacgggtctcaccatgttgcccaggctgatctgaaactcctaggctcaagccatcctcctgtctcggcttcccaaagcactgggattacaggtgtgagccactgtgcccagttctacagagggcattttaggcagaggacttaggatttcattctgaaggcaatgggaggctcctggaggatttggaactggacggtaacttgaactgtttaaaaaaggccattctgggccaggggcagtggctcatgcctgtaatcccagcactttgggaggctgaggtgggcatatcacttgaggtcaggagttcgaaaccaacctgaccaacatggtgaaaccgcgtctctactaaaaatacacaaaatttagctgggcatggtagcaggcacctgtaatcccaactacttaggaggctgaggcaggagaattgcttgaacccaggagacagaggttgcagtgagccgagatcccgccactgccttccagcctgagtgacagagcaagactccatctcggaaaaaaaaaaaaaaattctggctgctggatgaagaagggtgggtctgtaggggatgaagtggaagttgggagctcattacaagaggccaggaaacagactctggtggctgagacccaggtggaggtggcggggagcagtgggtggttttctggactcattaaaaggcagagccaaagaactttggagggactggacatgaggctgagagaaggagaaagggggagttgggggcaagtccaagggctctggctgagcacctagaagggggcactgctaggcagggaaggtggagggaggggggagtctggagggggaagctgcatgtcaggagtctggagcagggtgagtttgatttgagacacccaggcacccatggagagagctgaatgagatggtaagaaacccaagctgcagggagatgagggagttgctggcatatggaggcacttaaagtcaagacactgaatgaggccaggtgctgtcactcatgcctgtaatcccagcgctttgggaggctgaggcaggaggatcgcttgagcccaggagttcaagaccagcttgggcaatacaaatacagtgaaaccccctctctaccaaaaaaaaaaaaaaaaaaaaagccaggcatggtggtgcgcacctgtgatcccagctactcggaaggctgaggtgggaggatcgctggagcctgggaagttgaggctgcagtgagctgtgattgcaccactgctctccagcctgggcgacaaagccacaccctgcatcaaaaagaaaaaaaaaagaaaagaaaagaaaaaagaggcgagatcattaaaggagtgagtcagagaagaggcccttgtgggcttcctgctgtctacaagagaaaaggatgctgagacacgcctgccagtgaggcttcggagatcccagagactcggacacaccttggataagcaggctttctgactgggacctgagtctagctccttggcatcagtgtcccatttgtgtgtgtgcttgggtggtttggaggggctgcagctgagagctgactgcagggagaagtgacgctagggtatggcatggccccttgtggtcatcccgtcaccctcctcctgctgggctgggctggagagcgggagtgggggacacctttctttcttttttttttttttttgagacggagtctcgctctgtccccaagctggaatgcagtgctgcaatctcagctcactgcaacctccgcctcctgggttcaagtgattgcctcagcctcctgagtagctgggagtacaggcatgtgccaccacgcctggctaatttttgtatttttagtagagatggggtttcaccatgttggccaggatagtctcgctctcctgacctcgtgatccacccgccttggcctcccaaagtgctgggattacaggcgtgagccaccgtgcccaaccctggggggacacctttcttaccccttccccactcttctcagattcatcaataagctgcagccaggctccgtgaagaagatcaatgagtcaacccaaaattggcaccaggtgagcccagacacaatctcttccatccttgcccgcaagcccctcagacctcccctccccacccagtgaccaccacctgcccccctctagctggagaacatcggcaacttcatcaaggccatcaccaagtatggggtgaagccccacgacatttttgaggccaacgacctgtttgagaacaccaaccatacacaggtgcagtccaccctcctggctttggccagcatggtgagtgtggttgcaggctgggcagggggtggtgggcagcctgggctgggatgcaggtgtggccacttgtgctcctgagcccagtgaaggtggcggagcggggggcagggatcggggagcaggtgctgtcaacagcgtccaagggggccgggcgcggtcgctcacacctgtaatcccagcactttgggaggccaaggtgagcggattgcttgaggccgggagtttgagaccagtctggccaacatggtgaaatcccgtctctactaaaaatacaaaaattagctggacgtggtgacgcatgcctgtaatcccagctactcaggaggctgaggcaggagaatcgcttgaacccgggaggcggagtctgcagtgagccgagatcgtgccactgcccagcctgggtgacagagccaagactccgtctcaaaaaaaaaaaaacaaaaaacaaaaaacagtgttggccgggcacggtggctcacgcctgtaatcccagcactttgggaggccgagacaggtggatcacaaggtcaggagattgagaccatcctggctaacatggtgaaaccctgtctctactaaaactacaaaacaaaattagccgggcatggtggcaggcgcttgtagtcccagctactagggagactgatgcaggagaatggtgtgaagccgggaggcggagcttgcagtgagctgagatcacgccactgcactccagcctgggcaacagagcgagactctgtgtcaacaacaacaaaaaaacagtgtccaaggggactgtgcagcctggaggcccccttgtcagtccctgctttccctgccccacctaggcgaagacgaaaggaaacaaggtgaacgtgggagtgaagtacgcagagaagcaggagcggaaattcgagccggggaagctaagagaagggcggaacatcattgggctgcaggtaccgccctgtcctcactgcgcagaggtcatagaggccaggagggcaccctgatgtctgaaggcttttggggacaggatatttggcattaactatactataggccgggtactgtgcttatgctcatcttccattcacaaactcactcactctgccaacaccccagcagacaggtgcttgttatcaacataccctttccgcagatgagaaaactgagacccggagaagctggctcgcttttgcacagatcttccagctgatgcgtggcaggctggaacttcaatgctagaagtcagtcatgtgataggcccactctgggcctcagtttccagtctcgaaaggatgcctcaggcggggtgcagtggctcacacctgtaattccagcacttggggaggctgaggcaggaggattgcttgaggtcaggtgtttcagaccagcctgggcaaaatagaacccccctccaccgccatctctacaacaaatttaagagtttagccaaatgcagtggtgtctgcctgtggtcccagctacttaggaggctgaagtgggagaatcacttgagcccaggagttcaaggttacaatgattgcatcactggactccagcctgggcgacagagtgagaccctgtctctaaaaatgaaaatgggctgggtatggtggctcatgccagtaatcctagcacttcgggaggccgaggcaggcggatcacttaaagtcaagagttcaaggccagcctggccaacgtggtgaaaccctgtcactaccaaaaatacaaaaactagccggtgtggtggggcacacctgtagtcccagctactcaggaggctgaggcaggagaattgcttgaactcaggaggcagaggttgcagtgggccaagattgtgccgctgcactccaacctgggcgacagagtgagatgctatctcaaataaaataaaataaaacaaaaaaatagaatagaacaaaataaaatataaaaataaactaaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcaagatggagatttcagtgagctgagatcatgtcactgcactccagcctgggcaacagagcaagactccgtctcaaaaaaaaataaataaaataaaataaaaattgaaaaaaatgataaagcggcgcctcatcctctcccatcagctatgcctcatggcccatgatgaggtctgtaattattggtgtgattctccttctggcttcctagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggtgagtgggggcccccgggacacgccgtcaaggcccaggaccctggccaccccacggcctgaccacaccacccttcgcaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctc

SEQ ID NO: 36509 - DNA, 192789 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgttttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagatagaaacgtttatgctgagcccagggacaaatttgtgttagggagatgaggaagaaccagcaaggtaggtcaaccactgaggtgggaggaaaactgggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactcggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagttagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgatgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacttttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacagggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtaccttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtaaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcattcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatatatacagtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtaatcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcgaaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtaggactcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatgtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgttttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacgaagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagatctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgtgttttaattttaaaacttaaaatctgaaaatgggagctggaatgggagcaggtattttctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttctctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgatccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactggggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactggacttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaagggtataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatacggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagcttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccattttttttttttttttttgagatggagtctcagtctgttccccaggctggagtgcagtggtgcgatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacataattatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcgtggaaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactttagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggagtgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaattgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaatgtaaataagataatttttgtgaagctcattgaatgcgtctgagctccttaactcaaaaaaggctaaaagttactgaaatagctatggttaagggtatattgtcattacaatgtgataatcattaccaaagtgggcacttggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcgtttattgcagttcagtgtggtagatggctggagcctatcctggtagctcggcgcacaagtcaagaattaaccctggacagggtgccatccctttgaagggtgcactcacgcatgttccgcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgacctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgtttataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgattttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaacacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatccatttctatgtttaattaatttctatgtttaattaattaaactatattttataggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacaccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatatattgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagactagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcaattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttgcaaaatattgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggcaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagaggcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacagaatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacatataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctgtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacatagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctgtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtctttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggagcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgaagtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgtcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacaatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattgtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttataccattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagttgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctcttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcatgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattacaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtgtctcttgtaacggaataccaagtaattattgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagaagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacctccttaatgtaaccacctctcatttatggctttatctaacactactcaaagataattaccttgaaggtggtggtgttttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcagagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatgagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcattgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccaccctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttttgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacattgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcagtcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatgttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcttcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatgatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgtaccatatgcatacccgtatcacacctatcctggatgataccagtttacatagctgcctcttttcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccgctcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttctttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactgtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttcttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatctttttcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaattctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttaaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttctcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctataacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacgtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctagtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccgtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatacagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaagtggaggaattatgtattctattggatttaaaatagaatatatcatctgctcaagacacttagaattgatagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaagcccttctgttccagttgctccaatcagagtaatacactgcacagaaagcatacaagatatacgatgtctgtggacagatgctctgtggcattattaaccctggcagttgctttagccgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaa

SEQ ID NO: 36510 - DNA, 1249 bp, Homo sapiens
caaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgc

SEQ ID NO: 36511 - DNA, 1249 bp, Homo sapiens; identical to SEQ ID NO: 36510

SEQ ID NO: 36512 - DNA, 47601 bp, Homo sapiens
aatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacaggtagtgagggaggaaggaattgttgaacctatgttctggttggctttctaactcttgagtagtgactggcttcagtggaaaaggatggtgaggggtattctcaaatactagcctcctgagggggtcatttacattactgcatatattttgagaggcccaggcaagtctgcctcaagggtgactctcctggagagtaatttgggagcaggaatgtaaacctttttttaagtcacaattgtggtggaaagggaaagagagtattgctgatcagattaagctttagactccacactacagcccctgtcctcaccccaagcctcccaattactaggctatcaacacacactaaattcaggactttaaagccaatcttgtagataatctttttctttgttaattgaaatataaacagatttccaaagcagagcaggatagttttataatatacctataaaaattactaaaatgtcatcatcatggcaatatattcccactaaaatcttactgtgaacatcccaaatatgtgtagaggcccggcaaagtcttacagttcagaagagaactttcaatcctcttttttcaatgttattttccccttctatctgtccccccttcttagcataaggtttaataaaaggggatatgatgatattaaacatatttaatcagacaatattgatatctttttaaaatattaatcttataacccatgagtttcctagttcataccaaaatgtccctgcaagctgtattcagaaataaatagtaggaaggtgctgctttatcggcagtctgtacaatgcgtagactccttaaaaatttctttctgttcatattttctatttctctccctcttcttctacaattgacccagattctccaagtgcagaacagagagaagaaaggtgtggaagcctaaaggaaggaagcagaaagataggcaggcatttcaagttttctatggtccactaccgtcactagtgacccagcttctgcttataaataagaaaatttgtcttttaagagcactctaaatggttgccatatgagcttttgtagttcagaatgttaatgagtccaccagcatgctactcatgctgttacttgcctggagtattaaggattccaagaaggtagcgtttcaaagatctctgatctaatttctttttttggggggtcggggagatatgtggagaattaggaaatgtatcctcagatgatactgagaccaaatgcatagtgaattttatttttattttgtatatgtggaaatgatccacgatcatcttctaaggaattctggccgggaacagtggctcacgactgtaatcccagcactttgggaggccgaggagggtggatcacgaggtcaggaaaccgagaccatcctggccaacacggtgaaaccctgtctgaactaaaaatacaaaaaaattagccaggcgtggtggcaggcgcctgtagtcccagctactcgggaggctgaggcaggagaatggcatgaacccgggaggcggagcttgcagtgagccgagattgtgccactgtactagcctggatgaaagagcgagactctgtctcaaaaaaaaaaaaaaaaaaaaaaaaaaaagtgaaggaaacagaaccttccccaaagtcatgttgagaaaattagagatggctttttacaactttaaaagcagcagctaaatatttgctgaatgccagaaagaataaataggttgcttttgatctaagagttggggcaacaaaatggtttaggagatagaaagtagtagggtgcaaattgctatagtgagctcctcaagtaaaatagagaggccttcaacataaatttaccttttttactggccagaactcaatttggccagtaaaagaacctgccttctacaatgaagtctttggtttgtgtgtgcatcagaacatcttttaaaaatacggacttttcttctaacttcttttcctgcgaatgtggtgtaggtcaaattcgtgaactggttaagccgctgacaagagagggaagggcaccccagccaatgggaacccgtgctggtgatgtactgctcctaggctgcgattcattggctgcctagggtttgtcattctatccccggcgtctgcaagcagcgtgggtcgggttttccagctagctaaactggattttggccgctggcacgtgcagtttctattaactttagctcatctctacctcttaatagaagcagctgttatgtttctgattattctcctgattttgaaaaatcctgttcccttaacctacctcattggaggtcgttggaggtcccctgggacagaaccacgtgattatctaacatgtgcaaataaatacaatgtggaatcccctgaactatagagggaaaacctgccagaaactcagagcatgtgccccgtgcgtgaatcagttgcactcgcacattggtgggcggtggtagcgtgcttgtgtctctgccctttgggtcgcgaggtgtgtggccgtggcacctgcttgggcttcctggggtcactgggagaggaaggctctggaggagtgggactctggggtaggggggtctggcagctgcctgggacccaccatgggttcgaagggcagcggccagaccgcgacggcgcccaagaagggtggacagcttcgggtctgtgctcggggctgcgtgtacaccatcttcgcagggagtggggtttgtatctgcaggcaggtagaagagccagggctccgggcgcggacgccgtaggggtagcttccgagtccctacttggccaagggccggcacggaggggctgtcgatctactgggcacctaatagccgcacattctgtccagtccctggcgccggaacgtgaaggcccgggtcctggctgctatccgggatccggacgctcccttcggcttcggcctggtgctccaggccgtaaggcaaaggcggcggcagcagcagcggcagagaaagaagctgggtaaggcagtgacgtcatctgtggcggcccctcccccgcccgccagccctcaccgcagttcctgcccaacgacatccgggtctctgtagctgcgcgccgcgccgcagctgtagcggcggcggagccagcggggcggggcgagcggaggggtgggggaggggcgacgcggtcgtgagcgcgcctgcgcggggccgcgctagaggcggcggcggcggcggtggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtcctgggcttcagcccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaatatataaaccttggagaagaggagaaggtatagtgaggcaactgggtaaaagttgtgtcttcctctaagtaattttatgtcacaatatgtcctgtcttccatctcaaataacaaattttaaaattaagttgtgtttgttattttgctattagccaagatatataaattaactgacctgggattattagccatttgtatatgaaataaacttgggttaacctatatcaaaatcaaaagattgattatattctttacccttcactctttcaaatgtcttatgttctccatattacgtaacaattttatacttcattctgagtctccagaatatattctttgatgattttgacctttgaatgtcctggctatccatgtactacctagataatctcgttaccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagtgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatcttgtactgcatctcctccctgattctataaaccatcaaaattctttctaaactatggtttttcattatatcatttctctcagtatacttcagtgactcccatttacctctggaataaagttcagaattcttggtttggcttttgacactttccatgattggacctcaagacattagtctgttataaccaaactagtacacttgctatctctggaacacgctcttttctctccatggatctttgctcatgctagtgtgcagtctggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaatgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgtttactactttgcaacccactgatataaattatttcacagatcctttattcaaatgaaattctcagtgagtctgagaagatagtcttaaacacaagctagctgagtttacaatagagattatactataaatggtaacttcaatgtttattgaaaataaattccttaaaaacaggtcttgtttcattcatttaaagagattatcaatatatgactgttaaatttttatagtctccctgttcattttctgatgaacacatgacagaaaattgaatgtgagctggaaatacagcagactatgagaaagcatgggtcatgtataatcactttaaatttaggctggtgttttgtattcatctataatatgaccacctcagggagggatgtaagtaaacattctttttttagttatactttaggtggcttaattattttaaagaatatgttattcaagaattgtctattgtactgttttaaagaataagaatataattcattaccaactttgaatgtcttggattcttagtactacctttttctttatcatgactagtaggatcacatcataatttggtactgtgtgtataaagatgaagtgtgcttacctttattaccaaaattcagaaatgaaaatgtgaatgataaaagataagggatggctatatatttttttgtttttgtttttccaaacagaatctcataacttaccaggctttagaaaaacatctttgcagtatgccatcatacctcagaatgttaagtagataggaaataaaattttcactttttgtaaagcagtagggtattatcctttctgacagcctgtaagactgttttggttgccaaggggccaatcttagaagtggcagtttttgttttgtgaccaacccacagcttaccctttgttagtccatatctgtcatcttcattttctctttctgcgtaaatgcttcttgatacagtaagcaggtgtttcaactagtcagccatctagtgtgatcttttctggtttgctacagtcagtaaaataagtagctctataagtgtaaatagtattacttgttttatgtagtaaaactccaagattaagttagagatatttttggctagactacattgaatgcattgacaatggatttcccagctcccagaaattcgtttgtgtctgaattactttatacttggcttattgtgtagagaaaactttagaaaaagttcatccatccatgaatgttgaatgaatgagcagattaataaataaatagctcagggaaagaaaatgtgtgggcttttagtcataactatgttttttctcttttgttcccttccttatgtgccatttttcaataatgggagtgtgtatctaatgatgttgataaactttttaaagtcattgatgaacagtaatctgaaaatcaagttttgattaagccgtagatttcttttagggtccaatattttctttttagaaatccactatgatatttttgtagggataaaagacaaccatgtattctatagatggaaaatggtaggatacagtttgttggccggccaacttctctgaaaatactttttcctgcatagaagataatcagtgttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaattttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaacattcacccatttaaagtttacagttcagtagtctttagtatattcagacttatgcaacgattaacacaatttaattttagaacattttcatcacctccaaaagataccctgtactcattagcagtcactccccattcaccagtctcccagcccttatcaaccattaatccattttctgtctatagatttgtctagtttaggtattttatataaatggaatacaggtaactttttattagtgatttttcacttacatgtgtcttgcatgtctcatgagatagctatgaataagttagccttcttttacaacttaaataacaattcttgtctgaccgggaaaaagtattaagttattgagagactgcatcccaatttaaaccaagaaccagactccttactagtattataactcaaaagaatgtgtaccattagcccttacctctggtggtgcttttcactgtgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagggaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatcttccagaggattaaatggcaccatccccgtcaggtccaagtaggaggggaagaatcctattttgggtgctgtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttagtgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagatggcaccactgctcctagcctgggtgacagagggagactccgtctcaaaaaaaaaagttcctgggcttcaagggcactctaatgtgcacatcttaaattcttagagcctacttctatggacgatttatgttactgttgatggagaatttgattttcttttttatcttcccctttcccttggcctttgtaggttttttgaagtgaacatacttttatgtatttacttatttattgagcagttcccaaatggcaactttattattttatttcttcaactcagttgtctagtttacttcatttgtatctaatctatttaactcatcctttgagtttttaatatcaacattttaaattttatttttttagcttcaaaggtgtgcatatgcttgttacatggatatagcatgtataatggtggaggttgggcttctagtgtacccatcacccaaatactgaaggttggacccaataggtagtttttcaaccctcaccctctcccacccaattgtttttatttctgaaagtaatatttctttcttggtctgcctgataatttttttatagtttcttatttttcgttagttttcaaaaaataccttgttgggcattttgtccatagatgtactatcttatgtttgctaattccaatatcggaagtccttaggaagttgtacttaaggtagtttgtttctttctgtatttggtgattttttttatgagctaatatttgattaaaccgaatatttctccatcctctgtatagttgcctacaatgtaatttctacttttttttttttagcataaaagagtttcattttcctttttatactcaataacttgtttaattagccagtatttttaccagtttctttacttattgttccttgcatcttctctgagtccacttttcttcttgctgaagtacatcctttagtaatccttttagtaagaggctggcttgtaaatgtccttagtttttgtgtgaaagtatattttatgcattactttgtttttcagctagatagggaattcttggttgataggtttcctcccatcagcaacctcagtatattatttcattgtcttgtgaaacttggcaaacttggatctctgagaagttcgatctctgcctaattgttatgcttctgtatgtaattttttttttctggtagttttttaaaagatttcttttctttattctgtcaccactacttactgtgtgaccttgggcaagttcaaaatggatataaaattgtatctgtgtcatagggttgtaatgaggattaagttttaaagcacttagaacagagccttgcatattataactgtgacatgttaatatttgttttattttgccatacttgatattctaaacacatttctatgatatgcttaagtatgttgttttatccatagctcctctttgaaatacattgttgatgggaagattcatatctttctttgtttctagaaaattccttagccttcatatctttgaatattcattttccaatattccttcttagtctctgtattatgttctaggtggttcctcagtatcattttctaatttactaattcacactttgactttgtccagctagagtttatgtggcctcagttccagtgaattttttttaaatattcaggctgtctctctaatagccacctattctggtttgatttctgcctatttttaatttttcttcctttaatgactattgtggcttccttttaacatttgaaattattttcagattgtcattttttcttctagaatgaattacagttgttgattttattggctgtccatcttagtttagttttctttgtgtgttttgagtttgcttttgcagtctcctattgactggaagtttttgttgtgttttctttttcactcttcttatccagtgtttttacatgcacctacatctctgtctaaaaccacatctttatattggaggcttgattcccttgattcttggtaacatcaggatcaggcttctctttccaagaataagacacaaactaagatctatatttcttctcactggacacataatttcatctaaaccgtagccccatgcaatggttagtagtagctttttctggctcctttcattggttggaagagcctctccaccctaggtattggtttcaagcagtgagcctgagttctatcccagccatgcatgggtacctttttagtccctgttactatccctacaggatgtggacttttggccatctctgttacttgagcccagaaggctcacagttttagcttcaaaaactgctttgtatttaaagagttcagtggcttggtcttttttaatattttgtttgtatagttaataaatatttaacatacattaaaatgtttggaacagatacatttcaaaagtgaatatacaaatccatttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcactggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaattgcctgttcacattcattgcccatttcttttcctttaaggtgttcatttttattgtcttttaaaatagctgtttgtatattgtagtaatgttaacttttgtgtatatattgcagatgcttaaaagacgtttgcttttcaggttaatgagctttattttatagtgtaggagtttcttttctctggagtcactttttcttattcctttggaatcagtcttttcttgtcatccttagaaagtcctttcctaccataagattacagaaatatttgcatacatctactggtattgttttattattaatacttcagacttcaatctttaatctcttggtatttattttaaggtgtgatgttgaagggattcagctacccaccactggagggcaggagtggaaaagatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgactttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttctaaatattctataattgtagaaatatgtaaactcaatgcaaaaaactggtgtaggagcttactttttaagcaatttccacgtttgaggttttcttctttctttacacattatcaatatctactattaatgtataattcagatgtgtcatttcattatttcattttcttttttttttttttggtctgtggggtaggatgggggagtgtgttagaaatctataagcttttctttccaacatataatccaataattatttgatttttcaattaatgttttaagtgtgtttgaacagaatatatagtcttgaaattttggaccacatcttttaccaatttaaaacatggctcttattctgtttattgctttattccttgtgatttactttgtctgaaattgaaattgcaattcttggtatcttttttgcctagtgtatttcgaccacaacaaagtacttttatactgacatctttatttttgagtttcttggttttgattagtctcttgattgcatgaatctatctttaaatagtttattttttcagaaatgaaacatggataacactactttagtgctggcatatttgatcatgtcttcttcatgtcttcttattgcgtttacatataaatgacaaccttgctggtcgtagtattcttggaataaaacctctttatcctcaacgtttataggcattacttcgttgcctatcatctgatgttgcaaagaagtctgggaccagcctgatttcttttttctttttcttttttggcatgtttattttattttttttatttgagacagtcttgctctgtcacccaggctggagtgcaatggtgcgatctaggctcactgcagcctccgcctcctgggttcaagtgattctcctacctcaacctcccgagtagctgggattacaggcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatttatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatattctggtttcttttcatccctgtttcacaaattaggttttttaaaattttcttatatgtaagttgtcacctagttttctaaggtaaatcttttagactgtgacatcatgttcttgagtacttttttagttacttttttatttcagaatttttgtatgggttctataaatttttttctgcttttttacttaaagggtggcagttttctctgttgtttgcccaaaaataactagctactccttgcctgttctgtcattatactaggataccattacctctttcccccttggaatttaacaggctgaattatattaaattattttagttatcatatttcattatttttgagagaaatgatagggattttgtcctattaacctgttacaggtaagaaactttgtctttcttgatttttctcgatgcttgttgaaattactgattattttagttatcatatttcattatttttgagagaaatgatagggattttgtcctattaacctgttacaggtaagaaactttgtctttcttgatttgtctcttgatgcttgttgaaattactgcacattttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactcgaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtatatgaattgaattggatgtggtcaataaggattgctagggactcgagaatgcatgttgttctagggagaggaaatacgtgaaggtcaaattcaggttatcaggttatcagtttgtaacctagtttgtagctgcttttttcttttcatttcttacaagctggtcttgctgtagtaaaataattttgtgtgtctcttataatcttgatattgagaataagaggttttttttttaatgggaattccatccacatgattttaaagtattactttactaatgatatttacctaggtattcctagaactttagtcttctcatgtaacattttatacatttctcagaacaaggtaattgacaaataatcaaggttgcttatttattgatgaggaaagttagacattaagccaaaggacttgtccagtatcgcatattggatagacctataatttttaactttaatcttgtggtgacaggtatttccatttttttttttttttgatgtttcatatgtgctttgatgttgatgtgtcatgtgacatgaagtgtctccctattgttggataattgggcaagtctaagttctttttactttatattcctgattttgtttttctagatgtgttatttttacagattcaggttacttctttttttaaatcatgttattagagttaaactaatgaaaaatcatatagagatgaacttggttttgaaatataatgagtagatacttgcttggctggaattttttctcacaagttttttataaagatggtatgagtgtatactttgtatccaggaatgtgtgtacactagggggagtgttggggggatgagggtggaagacattttaagacacacaggaggctggtgtggtggctcatgcctgtaatttcagcactttgagaggccaaggcaggggaatcacttgaggtcaggagtttgagaccagcgtagccaacatgatgaatccccatctctactaaaaataacaaaaaattaactgggcgtggtggcacatgcctgtaatcccaggtacttgggaggctgaggcacagaatcacttgaagccgggagccaagatcatgccgccacatcccagcctgggcgacagagtgagactctgtctcaaaaaaaaaaaaaaaaaaaaaaaaagacacagaagaccctaagtgtacactcagatgctctttatatccatatccattatcagtttggtgatacgttattctagtttcatgaacctttactcttagaacttggtttattctctaatatcttttggattcagttttgcagttgagatggctaatatcaatttgatactctttccttttatgattgctcatgtttttgtctagaaccttgcattatagtatttttttttcttttccttgcatttctatagttgtgaacaactaggagtgggtttttagcaattaattcagtgagcttgttaattttgaaaaggcttcaactgaggaacactttcttctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatgaattagagggatgccaggatccacgtgaagagactaaagacgctagtattctgcagtgagaatgatggtaacttgagaccagggcattggtagaaaaaagtggacagatttgagaatgcttaggaagcatataacccatgggatttgatgatggactgatgggagatgaggtagagagaggtatcaaagatatccttagtttctgtttctttttctgagttggggtcttgctatattgcctaggctggtcttgaactcctggattcaagcaatcttaccgccccagcctccaagcagttgggactacaagtatgcaacaccgcacccagtgaatgttcttggtttgtattcaccttggtgggtgatggtgccattcactggtaaaagctgcagatatgtgagggtgctcagggaggcagcatagaatgggaaaagggcctacatgtaacccttgaggaatgccaatgtttaatggcttgggagatgaaaatgagcctgcaaaggagacgacggaaaagcttaggggtaggaagaaagctgggagtgtgtgtgtagcatcttgaaaggccaatgggaagagtgtttctggagggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggggagggttatgaaagaattcattgaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctcttttcaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttccttttttttttttttaaggtcatttatctttggcagttttagagatttagaaaagaaaatatatagacttgtaggcagaagaagatatggcactgagggaagttttagttttgttctgtgacagtcttccttatcttgtatgttgtctttaaaaagcctacacatttagattttcattacctcatttgcaaggatacaggatagcacatgtaggagaattggagtgtaagtccagaaacctaagtcttattcttagccttactgatgaaccagctttgtaaccttgggcaagttattctgtttctctgcaccttctcatttgtaaaataggtttacacaaatcatttctgcattttggctctgattcattatgcaagttatcaaaatcaaatttgtaactataaatgagtaatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccgtacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcaatgttcttttgttatatgagtaagaataactctggtatttgctaagagaatataattttctccacattgtatgtatctatgtcctttgtttataaagcctggggggcgttccctattaggttaagtgtccctacgtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaactttcatggacaaattgaatccccttgggatttactatttatggatatacgccaatttaattattggactaaataaaatactctttattagtccacttatggaagatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattaatttacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcaaccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaataaaacaaaaagtccctgctctcatggagtttacagccactattctaaagtttgtctgtattctgcctgtccttgtttttatacttttagcaaatatgtgtatagaattgttttgcagccttgttcagcatattgtcttcttttgttttttaggaatatctgtttatgtaattagatctgtttttgataaattgtattctgttatttatccttcctaccttctaatgagcagttaggttatttccaacattgactattatggttctccaaaaagatcattgaatatgtcaccttggatggatggatgggagagtttcttcaagacagcatgtttcagactttttgttgtgaccacagtaagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctatcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtagaggaaggaagtttgtcattactattcttttctgttggtttgtctcttaaatgtgtttaattttttgagtttcactcacgtctctttttttctttccttttctcaaggtagtggagtctttcctctgtaaaacttcaccttgttgtttctagtctaggatagtggtcttgtaacctaggatagtggtcttggttactgcaattttggttgattatttcttgttggcccttaatgtgcccccatcttctgccttaggcattccatctaatcttttccagcagtttgcaaccttactgtgcctcagaatcacatatgaaaatttaaaaatcatagatacctaggttccaaccctaccctggaaattctgatttggaaatatttatttttcaaaaagtccacagataattctgttgcacagccatggtagagacccattttcttaggggttaatgatgctttagagtcacgcagacttgaatcagagccctgattcctttaaacttattagttgagtgatcttggccaagttctttaatcttggctaaggttcttcatctataaattggagataatattattatctaccttagagagttgttgaagagattaaatgaagtaatgcttgtaaaacacttaccagagggacttagaatacttcttaaacattgcctgctaataaggtgtcattattacgttatcctttatccaatcaaaatactcacctttgcagtgtgtatcaacttgatgtcagaaaaataatctgataaatatcaccataagggatggatgatagctagttttcattacttacctttcgttagttgaactgtactaggaggcagaggagtaggcagatggttttatcacgccaatcagccagtcttttctgcctatgtatcagtttggacctataaggaaaatgaaggggaaaacaaatgtttttctttccttcctaggaggattttcttcttgccctttttctcccagtttcctctctgagctgagtatcattagcatcatcaataccctagtttcagagctgcgtagtgatttacctagatacttttctccaccattattccctactacctaactcctcttcacctccattaaatctctgttcatcatgctatccttcttttggattgcctttagttcagttgtgacttacttgattacttgaacccaggtgtctacatttctaagctattgttcaagtaagggccaaggtaaattctaaccagctgtctctttgccttgtgtgggcccattctagaccagcgggtgttaacttttgagtattggaaaaggattagattagctgagccttcaggcttgtcagcagggctgtcactagaccctttgatcttctttatatacctaatggtcatagagtataataataatggtacatgttattactatatgattaatagattactagtagtaattttgttatatatgtatacagtacacttcgttatgtatatatataattgcttgcaacttgaaatttgaggctacaacatttacagtaatttaataacttaactgactttatcaaaaactgaaaaacctcatggaaaaggtagaatgtaaggtagacttaaaaggataggtatacttttttctataaataggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttggtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatgtttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacataaaaataattgagttagtatataatctataaattcccctataattaagggttgttattttcaaatcttgaaattgtttattttttaaaattccacgcagtgtattatatagggcaaagttcaggaaacatgtttccagtctaaagagaggagtgatgtaagaagaaactagttgacatcttaagaaagggtattctcacttgtgcacacatatccttgattatataatatgctgatttaacatgaaatattttttcacattttaattttgatttgaagttaatcttatatgtcattttgtgcattttttgtcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtgttttgcaagtgtgaccatgttctttgtaatcactaaatagtgattgtaaaagctcctgtttgaagcttttattttttggaaactttttttttccatatgactttctatgaaacgatctataaaattgcttcaagtcaattttggaagtagggagactataacttataaatatactacagatttttaataaagtgttactcaaaactaattcctagacttgtcatggaaatgtcttatttgacatttcagttttaatagaacttttgaaaagggcattaagaaaagtagaagcttaaatataaagtataatctgagacttcaaaactacgatgcaactcaactagcttatgttagtattatatcttaagaatggcattgccattgatgactcataaccatttaaaccaattcaaatggaagtagactatatagactttttttttaatctgtaatttttagccttctattaactgggttggtagagtgttataacacattttagagtagactcacctctgctttaacataggagcccaaatatcttaaaagtgaggctcactattgacagcaagaaatagaactaaaataatatctgagtataagattatcttagaaattttaataaacacctggctatgagttactaagcaatgttttgctttctgaagaattaattttctgcatttttttacacttaggaggaatgttattgaagccgtttacaatagactgaatccttacaaaaatgacgacactgtaagtagcattttagctccctctgctttcccttcccctccactctaaatgcatatccttcctacctgtttttgcagagctgttcactgtacccattctcttacacacacccctgattgattgctctgaactctgcttgctctgatctctgcctgcaccacagttctagtgattgaggacataatcatggtgagtggccacctctctcaaaaaagaagaaagtccttttgaattattctagattttttaagtctttacaaacaatcaacttcagaaggtttgcctccactacatggttttttttttttttttttcccgaagttgggactatctctactcagaatattgtcttattctgagttttgtaagcagctgcagcagaacttcggaatgtctgtctcaactaaatagttcttatggttggaaatacctttgtcaggaatcctgaagtatatacttcacttaaatattagagaattgtttgcataaatagacattagaatgccatactctccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaag

SEQ ID NO: 36513 - DNA, 1295 bp, Homo sapiens
cacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcg

SEQ ID NO: 36514 - DNA, 5104 bp, Homo sapiens
gagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggagaaggcgccgaggtgcccggtgcgggccgaggcagggctgggcctcgcgggcagcaggcggaagaaggaagggcggtggggcaggtcccggctgcgcggggcagttgtgcgcacttgggttcttcacgcgggacacacgtggaacgccgacccctgcgcccctggccgctggcaactggcaaggccgggaacagaaagtgtagggacagaagagcgctggagtcttccccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccaggtattcttccccccgtgactccagggcacatctgccagagctttgaggttcatcgaggaagggagcaaagagacaaacccacctggagctttcctaggggcccattcctgcggacgggctctcctaaggggactgggccatccccacgcccctcggtttcccaggctggttggtacgcgcaggcaggtttcttgtctggtcctccaagggccgcgcccttgccgagtccctcagcgcccgcgcctgaggacttggtcctgcccctccggcggggatgagctcctccacttggcggcgcttggtgcagtgcgggcggctgcagtggcggcgccccttcccggcctttggaaaggggggcttaggtttaggggatcctacaagcctcttcgatctctgcccaagcagggacattttctaagtcccaatccgggtagtctgacatcctcccatcgcacagcccatgaagagctgggtttgggaacacccgaactgcgggcgcctcctgctatctggatgcttctttaggaaggcaaagttcaggttggactctggccatgaaggctgtggctgaggccctggggatgtgccttggtcacccctttcagcactgtcggcagtcccctccacgctgccccagaatagggccggatagtcatccctaggaagggactacttaaataggggacccaaccctgatgagtagaattgacatctgggtttaaatttctgtattttagggaccgtttgctaagcagagagcgaacactggcagaaaagcttaccgtccagtgccctcccttggcaagctgcccatgcctggacagaagcctaatggtgaaaatgacatctgtgaactttatttttagcccagtggtgttcatgtgcagccatatgaaaatctgcccgtgtgcctttactgtgattggtctgggatgcctagacagttcacttatcttttttctgaagaccaatctcatgctttaggttgaaaagttgggaatccagaataatatttgttcattctcacttccaactcccaccatcaccgaggcgggcaaatcacaaggtcaggagttcgagaccagcctggccaatatggtgaaaccctgtctctactaaaagtacaaaaattagctgggcgtggtagtaggcgccggtagtcccagctacttgggaggctaaagcaggagaatcgcttgaacccgggagacagaggttgcagtgaaccgaaatcgtaccactgcactcactccagcctgggtgacagagcgagactccatctcaaaaaaaaaaaaaaaaaagggataaaatgaaacaagactgttgtccccataccaccaccacccccacaccacataaaaccacagctgtgctgattgtatgtatgatttggagatttcaatcttgtagggagctatttggactaccaatggcatggccaagaaggaaactgcatttttagaggacttggattttgtatttttaagaacgttttttaaaaaatgcttacaatggaaggggatacaaaacaccgttttgttggggaggttcctaacgcatatgggattggcaaggagaaaccagccccttcccccagttctccctccactcctgcccagggaagcactactgttctccgtatctccccaaggtgacagctcctgctgatctgcccgcaggtctgcgagagccaatccctgccctgcatgcctcccctgggagaacaagtgtactcttctggtttgtaacgtagccacgcagccctttgccccacagcctggacaacattctttgatgataggagccaagcaacttaacttggctgcatgccagtatggcctggactgtggagactggggaccatgggggggttacacgtctgcctctacagcttaccacttcatttacacttgtgctggcacactgatactcctggatgtcccttttgttgtcagatatacatgtgtattcttagagcacagtgttgggagcatactggttaattaagtagtacttgattttaatagagggggactttgtgaattgcagattgattagtagtaaagctttcagtaactaaatctattttctcagcctgacttttttcttaaatgaactacctgactctattacatttttcctttgatttcttagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttc

SEQ ID NO: 36515 - DNA, 70429 bp, Homo sapiens
tcacctctcaccatctgctctgtggctcccagtgctgactctggaaggtatgtgcatgctgacattcggttaaaatactccagcttttgaaatgctcagaaaagcatccagatgagtacagggcacagtgttagcaggtctttctgtgcggtgggagcatgggtgaggggttttgttgttgttaatccgtagaatctaatttttctacaatacacatgaatttattttgaaatagtaaatttcaaatatttcaaattgaaatatttcaatattttttacattaatattggcatcaggaaagagattaagcatacttaaaatcactaagtcagttttaaaatttgatccaggtgacacatggcaacataagcctctgagtacagcttatggggttagaaagaggtttttagttgtaagtctgagatacatccacattgtgtgtatcagttattttttattctatgctcatttcacagtttcgtctgtgactggtgaacatttgggtctttcaagtttaggccttctatgaatagctgctatgacatttatgttttttttttttttttttttttttttttttttttttttttaaggaaataagcattattttctgtggtgtatgtatgcacgagtagaattgcctggtcatagactatatccgtttcactttagtagctcctaccaaccagttttctacagtggttataccgacttatactcccactagcagagaaaggcagttccagtctctgcatccttgcccacactttgtgttgtcaggctttttaggttttctgatggctaagtagttgtatcacatcgtagttttactttgtatttctatgatgactaatgataatgagcacctttttatatgtttattgaccatataagtatcctcatttgtgaagtgactacacaagccttttgtccattttaaaaataatctttgggctgggcgcggtggctcatgcctgtaatcccagcactttgggaggctgaggcgggcagatcatgaggtcaggagattgagagcatcctggttaacacggtgaaaccccatctctactaaaaatacaagaaattagccgggtgaggtggcgggcgcctgtattcccagatatttgggaggctgaggcaggagaatggcatgaacctgggaggcggagcttacagtgagccgagattgcgccactgcactccaacctgggcgacagagcaagactctgtctaaaaaaaaaaaaaaaaaaatttattgagatatgatgtccacgttttgtttcatgttttaaaacccatcattttaaaacatatatttcagtgttttttaagtttatttacaaggatttgcaaccattgccactgactccagagtattttcatcaccccgaaaaagaaatcccataccccttaagcagccactcactctcagctccctccttcccccttattctctcttccctccacctcgcaactactcatctgcttcatgtctctatggatttgctgatcctgtacacttcatataaataaatcatacaatatgtggccttttgtgtctggcttctgtcataggatagcgtttttaaggtttgaccatgttgtagcatgtgtcagaacgtcattcttttttattgctgaatagcagtctactggagggatagacattttgtttttcatttgtcggttggtggacacttgggttgctttcacttttggctaataatgctgccatgaaaattagtatgtacatttttatgtgaacatatattttctttttttttgttctgagacggagtctcactgcattgcccaggctggatttcagtggcgcgatcttggctcactgcaacctccatcccccaagttcaagcagttctcatgtctcagcctcccaagtagctgggattacaggcacctgccaccacgcctggctaatttttgtatagtagatatggggtttcaccatgttgcccaggctgacctcaggtgatctacccgcctgggccttccaaagtactgggattacaggcatgagccaccacgcccagccagtgaacatacattttcaagtatcctgggtatatatctagaagtaggattgcggggtcttatggtaacagctgtatatttaagttttgaataactgccaaaccgttttccacagctgcaccattggaaaacggctaccccactttaccttcccaccagcaatgtatgaaggtccttttgtccatttttaattgagttaatgaagcagtattttaaaagtaaaaactggatataccctatgtatccaaacacggaagttggtttaataaattatgacactccacagcatagaataatgctgaacctattaccaaacaaggttgatctataagtgttaacagaataagttagatgaagaaagcaagtagccctatttgcatgactaccaaagctgtatctatgtgtttgtgccagaaaagtctggaagaataaacaacaaactaagggcagtgaaaatgcagggcatgtgatgggggattcaagttttactttttcatctttggtactggttctttttaaaataaacacgtatttctgtggtaattttttaagtcacatatttaggtaaaacagatatcaaagaaagtttgtgcttggcataaagttattaggggaaggtttgagaagttctatgaactactgcagagcaacttcatgtcaaaatttgttaaatggggcatttctgtctttcttgtcaaaatgctcatcgaaacattggctctagctgtgaaaaattctctcatcataaaaaggatattgacaataagtacaacaaagtactaaaatttagctgatacaaatactaagtgaaaaacatcaagatacagaaatgtaatcagtatacatgaacagtatgacctcagtggtctcaaatctattcttgctacaccaaaatgtaaaaagaagtttctctgagtggtgggattataggtgattatcttcttccttatatctttttttcccccaaactttctacaatgcatatgtataatatttacagtttaaaaatgctttaaatttagtttgtagcttgcccatgtttaaccagtgaggtctaaaatgctagctatgtgatacgacttaaggcccataggactcaaaaattggagtctccgttaaaaaatggtgttttccagtaatatgcaatgacgtgaagatgaaaatgctattatataaagtagtatatggcatataattccaatttgttaaaaagtacacacatatatacttataaagatactagaggaaaacataaaatgccaacaggtcagttgttggtgtagggcatgtgggcgatttactttcccctttttgtgtccttctgtttccacttatttatttatttatttttaatttttaattttctttgagatggagtctcactctgtcacccaggctggagtgcagtggcatgatctcagcttactgcaacatctgcttcccggcttcaagtaattctcctgcctcagcctcccgagtagctgggattacaggtgcgcaccacaacgccaggctaatttttgtatttttagtagagatgaggtttccttatgttggccaggctggtctcaaattcctggcctcaagtgatccacccgccttggcctcccaaagtgctgggattacaggcatgagccaccacacctggccctgtttccagttatttataatgaacattatcagcatcttttataatttgaaaaaattcaaaatttagtttgagaagaaaaacattgcctctatctagatatggaatatcggctatcttttcaacttgtctttctctcccgtgcctcccagccatccttctattcctcctccacttggtgccataggttcctctcgccttccattcccatagctgctcctctgtccgcagctcatttcctcttctccagaacatagcaatctcttaacctagtttgttttcctgccgtcccttctctctctctctctgacctacttctggaagcacaaatgctggaataatccacgtggatgacactgctcccttgcttaacagcctgtggctcaccgtcctaatgctattactgggagtgttcagcccaaccttgttactggctgcctttacagggctggggagtgggatgcaacagttaccaagccccaccatgggccaggctctggagggcaggcccttttttgttaactcaccttttgtgacaaaaccatgcagcttgaccatgctagcttggaaatagggttccaaagtgtgtattcatgctacttacagactcagctctgccgctgaccttgaacttgtttaatccccctgcttttcctcagctgtaacacagatgtcctgcctccctcccagggagaggcgagggctgggcactctgtggcagttggtagctggtttccttgcgagctgttgtccctaagggatgccctgtacacctttgttgcccagaggtctcgaactgtgctgactgcccctttgctgtaagagctcagcccaactcatgagcccccattatctctccagccccagggtgggctccacatggcagacgttcctcatcagaaatgtccccaactgtcacctcccccataaatgcatccctctcagatttgactctgttgaaatgttcagaccagcgcccccaattatctttatgttcaggggttcatttctttgaatcttgacggggctcactctagaacacctaccaaattgacagggccacactggctgctcccttcccccttaaccgctttgtcctcatctccagcaatggcaacataacccctcggtctcccaaagaaatctaggccacagcacccacatctccctctcctcaactccacatgccaaatccagctccttctctctttcctaagcatggtccaagtccatcccactacattgctttgtgggcctaaaaggaagaggctgtagcacaaaccaagacttaaggagtttacttgagccaaagtgaggacagattcctggaaggcccagacccaagtaaccttggacattatctctgtttggcctttgttacaagcagtttttttaaaaaggcaaaaaagagggaccgggagtgggctgatacaaagttgttaggaattctcattagtttacagaaataacattgattagcgactggttatacattgttacactacagggtgtgggttatagtgtccagtgtggcattattaggttattttttagctacttgtgccaatggcaagcagtttcaagagatgaggccaggtgtggtggctcatgtctgtaatcccagcacttcgggaggccgaggtgggtggataacttgaggtcaggagtttgagaccagcctggccaacatggtgaaaccctgcctctactaaaaatacaaaaattagcctggcatggtgtcttatgcctgtaatcccaactacttgggaggctgaggcaggaaaatcgcttaaacccaggagaacgaggttgcagtgagccaagattgtgccactgcactccagcctgggagacagagagatactgtcccaaataataataataataataataataataataataataataataaaaagatgaatacacagctcaaagtggggactagaacgttattgctgtctcattttcatgattctctgggcctgataatttaaaagggcttgcattcctcagataaaagttactttctcacctttagtccatgacttcctcgcgtcttgtctgaaccgttgccataggctcctcttatgctttctttggcatccccagcctcaccctgcccctacccatgtccctccttcccaaggcagccactgttcccgctattgctgccactcagggcagcatgacctcgctggcacactccctgtattaccgaccttgagctaagtgctttacgcactgactcttatcattctcttgacaaccccagaagggtagattttaagatctccacttgacagattagcaaaaccaagcttcagagaggtcagctaactagcctcagtggtgggccgggaccaggcagccagagcctgtccctgtaaccactagatgcttgtgctgcctccctgcagcggcctgggcctgtctgttgacttccttgtgaacaggcagggaccctgggtctttggctgtcaaatgtttaataagtgagtgcttgccttgcacggaacccacaccacacttactcaggcccctggctttggttggggtcaggctccatcatttgctgacccttatctttaaaagttcaccctgaggggaggaatgtttttaaaagttttaagttatagcatccattacaaaaacgttttccattgtgaaaccccacagaattgatattgtgctgcaaggatcaatcctgcctgacgcaggtctgccagctgccaaaaaactggttaaacgtgttaagttcagaaaacctattgtctgatgctttctcactgattaaatgagttgtattgacccagcatgttgtaatagttgaaaggttataaattaactgcatatactctatcccacatgtagacgtctgaatagctaccacggtacaagcaagaagagattttagaaagttaaaaccattggcttttctcacaccccctcccttcttttcactttttttcagctttatcttgggtaaaagatgtgtgatcagacctttctcgttaatgtatttggctcatgtgacaaatgtttcaaacaacgagctctgagaccagttttcaagaagtctcaacaactcagctactgttcaacatgtgcagaaattgtaagtgccacttaaaaaaaattcagttatctgtcttaaaacagtcaagcgagggtcctgtgacagatgagatgccatagaatcagcttatataacacacacttttcagtatgcctgggcttggtgaggcagtatagtacagaggttcagggtgtggactctggtgtctgactgcctgggtccaaatcctattgatgttcctagttattggtgtgcaaggaggttctcacctctctcctgaagcctgtttttcccatctgcaaataggaatgctaatagcacctacatcataagagttttatgatgatcaaatgatttcatttgataacttattttaaatagtacccagcaaggaaagtactcaatgaatgttttagcttctattatttcttagggctaatacttttttcttctgacttctacaagtctgcttggcaggcaatcaagctaaaagagaagctggcaaataaacagtctaggagcatctttccaaggaccggtcccagtggtgtgtaggtccagctctaatgaagatggaatctcacagggcctcagtagtgagcaaaattcagctcagaagtactccttgggcctaagccttcaacaaagactaggaatggaatacaaatcctggaatttttcaaagtacacaaaatcaagtcctcaccagaggtggctgtgcacaggcttcagatcttgcagcaaaaatgcccacagcatcactgaagccctaagaattagtcctatctctgagaatttgcaaagctgcgctcaatagtgcagctgagcagagcccccacttggtgaaaagtggtaaagcactcctcctgaaaagcccagtaggaaatccccacacatttaaaaaaacaacaacaaaatccataatacaaccaaagagaggaaagatgacttttacattttatctaactgaaaaagaaaaggcactttttatcctcctgattccactgtaacccctgaccatgattacattaaaaattattcccttaaagcaaatagcaagtaaacagcccagggtggcataaaaaggctttgatacagcatagcaatttggatatgtcttcagcctaggtgtagtgggcttctacctgtagtatatttctacagtctacgttctaacttggccctgcaaattgtagaactgaggacatttagttcttaaaaataaacctgctttctgggggccttaccccccccccattatttattaatctaactcttctgctttttaaacaacttcctctgcaggtggaataagcccaagaatcccagattttgagtcctctgtggcacacaggttctccctagcacaggggccatgcctggagatacttttctagggaatagttgccagctagcgctactattaggttggggcaaaagtaattgcggtttttgccattgctttcaattgaagcagtggcacgatctcggctcactgcaacctctgactccagggttcaagtgattctcgtgcctcagcctcctgagtagctgaggttacaggcacaaaccactatgcctggctaatttttgtatttttagtagagagagggtttcaccatgttggccaggctggttttgaactcctgacctcaggtgatacactcaccttggcctcccaaagtgttgggattacaggtgtgaaccactgcgcccggcccacacaatcttacttaattctcataacaattctcattgctttcaattgaaagcaatggcaaaaaccacaattactttaatacaatctctactctctacttgggggttcccaaatattcagacagcatcattcagctgaagagacatccagtgactgacagctggcctttcatccaactgtttgggattatgtagacacagtccccattgggccctttttgtgaataggagtgaccctttatctcaaccactgtggaatgtagctgacctcaacttttctgatatccagcttcctcagtgggagttaacaccaaaatacaagaaagtacttggaaaactgcctaaccattaaaagtctgatggcctcatctctagatagttgactctccaggttggaggctgttcgaggtttattttacacaaagaacccccagaagagggcacacaccagtgagaagtaccacgtgcctcaggtcttcacagccaggaggaccttgaaccacacacacatcctgcaacggtccaaacagagccagcctaaggaggtgatgagatgaggctgccttgcctgggccccctgagatggcccttgtgagaagaatcccccatgacccagtgtctcatttaaattacctcatgtgaactgctcaagcgtatcaggcagcctcagtaataataacagatgcatactgtgtgccacgcactgctctctccgaatgccatacagagtctgaaggaggtgttgtcccccattcacagatgaggagcctgaggcaccacaagtaaatccctcaggccacagagcagagccaggatttgcccccaggcagtcagatctagatagagcctgtgctcttaaccttttgctttacaaactctcaaacaggtgtaatatttttgcttttatatattcttatcttatacttaataattgtatttatatatttattcatttataaacatgtttgttatatgtttatatttttaacatagtttatacagatttatatattttatatattttttatacatccatttaataaactagcattaactgagcacctaccatatgcaagtactatgctaaatatctaaatactaaggaacagcgacaagtaaacctattattatacggatgggaacggaaaagagaactagcagtgaataagcatctgctatgtacggagaagtctgctaaagtcttcacccacactatcttacctttttttgttttgtttttgtttttgtttttgttttttttgagtcttgctctgttgcccaggctggagtgcagtggcacgatctcggctcactgcaacctctgattccagggttcaagcgattctcgtgcctcagcctcctgagtagctgaggttacaggcacgtaccaccacgcccgactaatttttgtatttttagtagagagagggtttcatcatgttggccaggctggtttcgaactcctgacctcaggtgatacacccaccttggcctcccgaagtgttgggattacaggtgtgaaccaccgcacccggcccacaccatcttacttaattctcataacaatcctatgaagcagatcctatgaagaagcttttccagataaggaaacggaggatcccagactctaacctgcaaaacaactatgtacagattaacatcgagtaccttcaacttttctcagatagagaaggcccgggacagcaagtggaggctggcttctctgggagggagcaggtacagagaggtggggacagcacccaagattctgcttggcgatgttctcgcagcatctgtaactttgatctgccttctcattctctgcacaaacgcatgcaagatcacataggagggaaaaaggagaaggcttgagttggatcatccacaccaaagtccagagcactagggagccagcctgtctgggtccaaatcctgtctctccctctttcttggagcatgccccctgagcaattactcagtctttctgtgccccagtttcctcttctgtaaagtgggaataagtgtgcccattcaagttgactcctgtgaggattaaacaagtgcaaattaaagcacttagaacagtgcctctcacacttcaggcgcttgcggagaggggatgcttcagtctgacagaagtcgctaaacgtgcatcctggcagaactgtgccagcccttcattctaaagggcaggaggtggcctcagaagtgagaggtccgagatgcctgggcgtgggctcagaagccccaggtctgagcctgcgcgcccacttgacccaccgccatctccttttgccgcccccaggccagggacctgattcctgcgtgaagaaaagagaaaataagggtgggcctcctaatgccgcagagactccgtctgagaacccagcaactagttttatttttgtatatttagatcaacaaacgaagagggtttccggttccttgttgggggagcaccgtagctacctgcggccaagcctcgtagccgtctcctctcccgtcctctctctgcctgcaggagccacgggcccgcagcccgcaatcaagtcccacagagcggagatctgcacgagaggcttggggatgggagggccatgtcgcgggggcctcaccggtctccccagaagcggggagtcccgagttggaatcccggcttggcccttccctctgtgtgcgtcctcgggcaaatcacccagcatccctaagccacagtttgcccgctggtaaaatgggcgtcacactccctgcctctcccggaggagagaggctgacgcggacatcgcaccaggcactgcgccagagcgcgcgcccaggtgcggggtcttggggctcaggcgcagcagccgggcccgcagctgctggcgtcatcgcggagggcggggccgcggggcggtgctcggggccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagcgtgagtgcgggccgggaggcgggcggggcaagccggaccggctcgccacttcccgggcggggacggcgggggcggtgggggcggtcgtggctgcgacgggagccaggcccgcgccaccgcccgggagcagggccctggggcccgggcgcgcaggtgaggcgcgggtagcggtcccgatccccgggacgcgcggcggtggggccctcggagggtccgggcacctggccgacccccgccgccagctagcggaggaccgcgggactagctatcctcatcacctgcctggaagctgcgaacggatcgcgttcttgcccctcccatgcggagggcagggggtggggtgtcggtggtgacgagcgagcgcggcgagcccgtgtaggcgcggcctaggagagactcctgttttgttttttaatgcccgtctggctttctccatcactgttgtatcttttctcagttttgcttttatgagactgcaatttcaaagctcatttttccaacctctcccctatccttggggcggggagctggatgacggagagagaagggaaacggaggagctcactaaattcaaccgttcagttcgtttaaggctgtttaaaaagcttttggatcgatgtggtggattggcataaaaaagccatagcgatcttaaacttgcattcttcaccaccaccaccgtaattcagaactggctctgtgatttttatgagtgagcgattaaatagccaggttcagcggctcttggccaaaacagcgttcctttactttgtcagagggctcctcctcagcagagcttgggctgggggccaggcttggggaagtggttgtatctgctcacttttgagctctgagggtggcatctcccctttgctgagcacctcccacggtgccctcctgcacaccttgacgttgttctcctgccattcctaatcgatgccaccctttacattctatgtggaatggaaaaatggggttcgtgctagggcctttaccttttgatctctgaagatcacttaagagaagtggatgacctggatctagcgtgtgctgtgctttcctaggggtcttctttaaataggaggcactctaagcttagaaatcctgtccagcaatcactaactgtaaaccccaaataatgtagttatgcaaattgagagttacttttcttacataacaagagcaaaggtggatgatcacctgctgttgttcagctgcaccatgcaccccccaccaagggacccaggctccttctgcctttcttctccacaccttagagcagtggcatttgccccatgattataatatgattgccacagctccaaacatcacttctgtatccaaggcaggaagaagggggaatatggacaccaatctctctttgctccctatcaagaaagcaaagcaaaagttttcccagaaatccttctcccagtttgagaccagcctggccaacatggtgaaaagtattcataggtcatctaatttctccatttgacagatgaggaaactgaggcacaaagaattaaaggacttaccgaaggtcccctgctaagtgttgggacccggattccccccaggcaatcagagtgccagctcaggctcacttcagattattttcgccaaacccgttttgagcttcatgcagagggcgttctccagaaactcacttattcaatagtgcaggctgcatgcctggatattttcaggttttctgtgaatttgtaagttgccttaagacagagagcagagatgcagcttttcaaagggaacctcagggggcaaatgtagtcaatccaaaagaagaaacttttttttgtcctgccaagagtgtggtgccctcaaaagctagggccagattttagacccacagtggaagggtctatccctacctgcatatgtcagaatttgtgagctggaaagaccagaagtcatgtggttgtgtccctcttgattcccctgcagcttccagaccacttctcttctaccccgcataaagcctttgcttcttgaaggttcttatcactgtattgacctcttcccctttgacatgtctcctgatctcccagccaggttctctcatttctctacttttcttttcttttttttttttttttgacacggagtctccctctgtcacccaggctggagtacaatggcacagtcttggcttactgcaacctccacctcccaggttcaagtgtttctcctgcctcagcctcccaagtagctgggactataggcatgtgccaccacacccaagtaatttttgtatttttagtaggcttcaccatgttggccaggctggtctcgaactcctgacctcaagtgatctgcccgcctgagcctccaaaagtactgggattacaggtgtgagccaccgcactcagccattcttttctttattcatctttatttttaagagacagggtctcggaccgacagggtggctcacgcctgtaatcccagcactttgggaggccaaggcgggtggatcatgaggtcaggagattgagaccatcctggccaacatggtgaaaccccgtctctactaaaaatacaaaaattagttgggcatggtggcaggtgcctgtaatctcagctacttgggaggctgaggcaggagaatagcttaaaccagggagttggaggttgcagtgagccgagatcttgccactgcactccagcctgggcgacagagcgagactccgtctcaaaaaaaaaaaaaaaaaaaaaaaaggaggagctaggcagaggccccaggagggggtgtgtttggtgtatctgatgtatctgaggaagagtgaggaggcaggtgtgtctggaggggagtatgcagggcagagtccagctgcaggttatgctgggagctcatgcaggaccccatgggtgcagtgaagatttgggctcttactcccagtgagttgggaaacccttggagggttttgagagagaggatggatctgattgctttactgggctcactctgcctgccatgttttgtggcagaacaagacagcttgagggagggaaatgaagtgtgagaggtaagtgacctggggtaagagttcttgacaaatgtctctttccctcttatcagagagcctaccttgcgtgccacttgccagctcctaatggaagttacagctgaaggtggaagagcgagagatgatttctgagcttgtcttggtcccatagttgaccctgcagccgctcttaccttaccccagcccagactcgcccagctccttcctaagtgtgtttgtcccttggcactcaggtgggaaagggaggaaaggatgctgatgagttttacttgtggaagtataagctagagccctgccaggtgcaaacaacagtgctgtcatttttccctgtatgaaggaaagtggtatcatccccatctgtgcgatgagcgagcaggcttagcaaagtcgaataattccttcagggtcatgcagctggttagtgattgggccaggattcagtttaggaatgatgcagctttctttgcagggctccccattgagcaagtggctgagagcctgggggaaggtgggaagggtctggtgaggctggggaggaccataaactgaatctgttcactccccagagcaggggctggcagcatgcactttcctgtatctcttatggtgactggcagccccttagttaacagatgtttttgtttgtttgtttgttttgttttgtttttttttgagatggagtctggctctgttgcccaggctggagtgcaatggcatgatctcagctcgctacaacctccacctcctgggttcaagcagttctcctgcctcagcctcctgagtagctgggattacaggcacatgccatcacacctggctaatttttgtatttttagtagagacagagtttcactgtgttaaccaggctggtctcgaactcctgaccttgtgatccgtccaccttggcctcccaaagtgctgggattacaggtgtgacccactgcgcctggccgttttttgtttgtttgtttgtttgttttttgagacggagtctcactctgtcgcccaggctagagtccagtggcacaatctcagctcactgtaagttccaccacccaggttcaagcgattctcctgcctcagcctcccaagtagctgagactacaggcatgtgccaccatgcctggctaatttttgtatttttagtggagaccgggtttcaccatgttggacgggctgttcttgaactcctgacctcaggtgatctgcccgcctcagcctcccaaagtgctgggattacaggcgtgagctaatgtgcctggcctgacagatttgtttctgacacacacaggccttgtttcttgcccagctgagattcccagcccctgcttcgtgatgacctctgcagatatttcccattttggaatccaaggatggtttcctgtgaattgggaatgtgtggccagacacatgagttttatagtaccaaattagggtatgcggctgacaccagaggggtatggtttattccccagagcaacatgtgttagatgcctgtacatttttgcattttagtgttgctatataggtggcccagtagcctctgccctagtcagggagacccctttaggctatcagctaaggtaatcaactcatcccagtttgcctgggaccctaggtatgtgtgtttgtttgtttgtttgtttttgagacagagtcttgctctgttacccaggctggagtgcggtggcacgatctcggctcgctgcaacctccgcattccaggttcaagcaattctcctccctcggccccactagtagcaggcacacaccatctcgcccagctaatttttgtatttttaggagagatggggttttgctatgttggccaagctggtctcgaactcctgactttaggtgatccacccgcctcagcctcccaaagttctgggattacaggcgtgtgccaccgtgcctagccagaccctaggttttaaaatggaaagtcctgcaccccaggagaccctgcggccctaggcaaaccaggatagttgttacctcctattggcttggacttgcccaaattcttgccttaaggtagcttaaggcaacatattaaaattgtatagcataaactttgaggaaaaaatggtttcctctcttcagacactgagttcttcacctccatccctttggccctcatccccaagccagacccttggccaacattaaatataggaagtattaatagcttatatgggtcctctgatgggaagccagctcacatcaaactccacagccccaagccccattttccccttcctcccacagagcttcctgcttctccccagagctttctccttgtcactttctgcttatcttctaccacaggcgagtactacctcgcttgattccaaggcattttagaatcatatggttacagtgtgcattcatttctgattgctactgtacaaatttccacaaacttagtggcttgcaataacatacatttgttttcttatagtgctggaggtctataatcggtgactaaaatgggtgggcaggtccttctggaagctttaggggagaatccatttcttgctttttccagcttcttggggctgcccatgttcttggcccaaggctcacgtgattctgagcactgcttctgtggtcacctctctctctgactctaacccacctgctccctcttattaggatccatgtgattatgttgggcccacctggataatccaggataatctccccatctcaagatccttaacttaatcacatctagaaagtcccttttgccgtaagatagtatcgccactggttctggggattaggatgtggatacctttgggggccattatttagcctatcacacagcttttagatcaggagggttcccctgcttcagcttcagtcttccagcacaaaacatttccttctcttcctaacagccctgtcccttatagatgaaaaagcagctgagatccagggaggggtgaagggatttccctaagattttgtagctactctaatgttgaatagggagtagagaagattcaagctcccaggacagctgtcctcctcaccatgctagaccttctcttagaaagttgagatttgccaacagtctccctaactgacctagttccgtctacctcttccacttcaccttggatcagtctatgctttgctcactatcgccagtcacactggccatcttggtgagcttcagaccatcaagcttgttcttgccttcagccttcagacatgttgtattctctcttctggaatgttctcccacttctttgcctagtttacttcatatattctgtctcggttcatattccacctcctcagaggcaccttcccttattataaaaagcagtaaatgtgctgggcacggtggctcatgcctgtaatcccagcactttgggaggcagaggcaggtggatcacttgagcccaggagatcaagaccagcctgggcagcatggagactccttaatctaaaatggccatgtctgtcccaacttcctacaatttcagctccctttcattgttcacttcatcactctctaaaattactttcattcatttattctttgttgactgattgatgattggttgattttatgtctcccttactagaatgtaagtaccttggcagcaggtactttatttgtatcatttactgtggatcaccctcctacaacagtgagctaggctaagtaaatatttatcaaatgaaaaaaaaagattggcattgaaaagaaagaaaagtaaatccacgtatgaaaaggtgccgattttttttattcagtaaaagaaaataaaaagcaaagtgccaaacagtatatataacatgatcttaacaaacaagaggtgcttgtatatgcagtaaatgtctggaaggatacgcaaggaacttgttatcgctagagaggggtatggaaagtgaaggtgcttttcattttatacccatctatacatttactgtttttgagccaggttctcactctgtcacacaggctggagtacagtggcccgatcatggttcactgccgcctcaaactcctggctacctcagcctctcaagtagctgggactacaggtgtgtgccaccacacctggctaatttttgcatttttttgtagagacgaggtttctccatgtcgcccaggctggtcttgatctcctgggctcaagcgatccacctacctctgcctcccaaagtgctgggattacaggcatgagccaccgcacccagcacatttactgctttttataataagggaaaaatgagtactagaatgggagtcaagatcaagaataaaaggaggccgggcatggtggctcactttggaaggctaaaacggaaagatcacttgagcccaggagttgaagaccagcctgggcaatatagtgagacctcaactctcaaaaaaataaaaataaaaaaataaaaattagccaggcatgatggtgtgtacctgtggtcccagctactcgggaggctgaggtgggaggatcacttgagcccaggaggttgagactgcaaagagctatgattgcaccactgcactcaagcctgtgtgacagaataagatcctgtctcaaaaaataaaaaataaaaagagaaaggggaaaacaattcaactctaaagagtctttaacttgaaattaaactgaggaataatctgcaagacaggctcaaaccagacagaccaggaaggacatggtgttcatttcagccaacaggcacagcagcctcctggggctgtgtgggagctttactccaattcccaggtccttgaggcagatgctaatattgttaaggaacaaagcaagtttatgtcgtttctctgagtacaaatctagactaaatttgatagaaggatgtattatctgataccattaacttttctatctattctaaatgtaattttttgaaaagttttattattgaatgctttatggcttagagtcttggactattctgatttatggcttagggaaaaatctaggaaaaccaactttctagattagcctggagcaaacatattccttgacttttttcatattctaagaaaatgtgatctgtgtaccgacgcttacagaagtcggtttctctacagtcatcctcttccctgctgtttggccacatgcctcctgcagccatcagaggcagcagaaagctaacctgccttcatttcctttccccttcctttctctgcattcactgttatactcgagctggctaatgcaagggtgtttagagtactttcccaataaacaaatgctcactgtggaaaaatctagaaatatagaagaaaacaagtcattcataatctcaatacctagaggtagccatttttaatattttcatgtatttcatagcttatgtttccatgtttgtgtatatatttataagcttactagggactgtactagatagaggatttgagcccagttttaacattcagcacaatggattgagtagctccccatgtcatttacatttcttttaatgtcatcattaaaaattcttatatggaaccttacagtattcaatcttaaagatggtcccataacttaattctccaaacttttaattagggaattcagggtagaattttttgtggctcatgaatttttttttttttttttttttttggagatagagtctcactttattgctcacctggagtccagtagcgtgatcatggctcactgcaacctccacctcccagattgaagtgcttctcttgcctcagcctcccaagtagctgggattatagtcgcacaccaccatgcctggctaattttttttttatagtttagccatgttgtccaggctggtctcaaactcctgacctcaggtgatctgcctgcctcagcctctcaaagtgctgggattacaggcatgagccaccacgcccagcctcatgaatttttttaaggcaattcacaaatctctgacaaatacaagtgagataaatgtgactattaatgttttccttccatacaggggtttgagagggtttttttttttttcttcagcttttaagttccagggtacatgtgcaggatgtgcagttttgttacataggtaaacatgtgtcatgtggtttgctgcacagatcaacccatcacctaagtattaagcccagcatccattagctattcttcctgatgctgtccctcctgctatgcccctgacaggccccagtgtgtgttgttcccccgatgtgtccatttgttctcatcgttcagctcctacttataaaggagaacatgtggtgtttggttttctgtttctgccttagtttgctgaggataatggcttccatgtccctgcaaaggacattatttcattcctttttatggctgcatagtattccatggtatgtatgtaccacattttctttatccagtctatcattgatgaccatttgggttcatttcacatctttgatattgtaaatagtgctgcaatgaacattcgtgcatgtatcttttaatagattggtttatattcctttggatatatacccagtaatgggattgctgggtcaaatggcatttctgcttctagatctttgaggaattgccacactgtcttccacagggttgaactaatttaatttacattcccaccaacagtgtagaagcattcctttttctccgcaacctcaccagcatctgttacttcttgactttttaataatcacctttctgactgacatgagatggtatctcattgtggttttgatatgcatttctctaatgatcagtgatattgagctttttttcatgtttgttgtctgcatgagtgtcttcttttgagaagtgtctgttcatgtcctttgcccactttttaatggggttttttttcttgtaaatttgtttaagttcttgtagattctggatatcagacttttatcagatggatagatcacaaacattttctcccttctgtagtttgtcccttcactctgatgtagtttattttgctatgcagaggccctttgttttaattagatcccatttatcaatttttgcttgtgttgcaattactttcggcatttttgtcatgaaatctttggcccatgactatgtcctgaatggtattgcctaggttttcctctttacctcttttcttttctttcttttctttttttctttttctcttctcttcttttctttttttttttttttttttttttttgagacagagtctcgctcttgtcacccaggctggagtgcaatggcgtgatctctgctcactgcaacctccgcctcctgggttcaggctcttctcctgcctcagccttctgaatagctgggattacaggtgcccaccaccatgcccagctaattttttgtatttttagtagagacggggtttcaccatgttggccaggctggtttcaaactcctgacttcaggtgatctgcctgcctcagtcacccaggctggagtgcagtggtgcgatctcggctcactgcagcctccgcctcctaggttcaagtgattcaagtgcctcagcctcccaagtagctgggactacaagcatacgccaccacacctaatttttgtatttttagtagagacggggtttcaccatgttggccaggctggtctcaaactcctaacctcaagtgattcgtccacactggcctcccaaaatgctgggattacaggcgtgagcccccacatccggcctggtattgcctagattttcttctagggtttttatagtttggggttttacatttaagtctttaatccatcttgcattaatttttgtataaggtgtaaggaaggggtccagtttcagtcttctgcatatggctagccagttctcctaacactatttattaaatagggaatcctttccccattgcttgtttttgtcaggttcatcaaagatcagatgattgtaggtgtgcaatcttatttctgagctctccattcggttccattggtctgtgtgtctgtttttgtaccagtacccagctgttttggttactgtagccttgtagtatattttgaagttgggtagcctgatgcctccagctttgttccttttgctgaggattatcttggctatatgggctctcttttggtcccatgtgaattttaaaatagttttttttcctattctatgaagaatgtcaatggtagtttaatgggaatcgcattgaatctataaattactttgggcaatatggccattttcactgtattgattcttcctatccataagcatggaatgtttttccatttgtttgtgccctctctgatctccttgagcagtggtttgtagttcttgaagagatccttcacttaccttgttagctgtattcccaggtatttgattctctttgtagcaattatgaatgggagttcactcatgatttggctctctagtgatttttgcacattgattttggatcctgagactttgctgaagttgcttatcagcttaggaaacttttgggcttagacgatggggttttctagatataggatcttgtcatctgcaaacaaagataatttgacttctctcttcctatttgaataccgtttgtttctttctcttgcctgattgccctggccagaacttccagtactatattgaataggagtggagagagagggcatctttgtcttgtgccagtcaaggggaatgcttccagcttttgcccattcagtatgatattcggtgtaggtttgtcatatatggctcttactattttgagatatgttccttcaataccttgtttattgcgagtttttaacatgaagggatgttgaattttattgaaggccttttctctgtcttatcgaggtaatcatgtggtttttttctttagttttttttatatgatgaattatatttactgatttgtgtatgttgaaccaatgttgcatcctggggatgaatccaacttgatagtgttggataagttttttgatgtgatgctggattcagtttcccagtattgggaatcatttattgatgatttttgcaccaatgttcatcagggatattggcctgaagttttcttttttcttttctttttttttttgaaatggagtcttgctcctgttgcccagtctggagtgcaatggcatgatcttgactcactgcaacctctacctcctgcgttcaggcgattctcctgcctcagcctcctgagtagctaagattacaggcgcctgccaccacgcccggctaattttttgtatttttagtagagacagagtttcaccatgttggccaggctggtctcaaagtcctgacctcaggtgatccacccgcctcagcctcccaaagtgctgggattacagacgtgggccactgcactcggccaaagttttctttttttgttgtgtctctgccaggttttgatatcaggatgatgctgacctgataaaatgagttagggaggagtccctccttttcaattgtttagaatagtttcagaagaaagggtaccagcccctctttgtacctctggtaaaattcagctgtaaatctgtctggtcctggacttttttttgttggtaggctatttattactgccttaatttcagacctcattattggcctattcagggattccatttcttcctggttcagtcttgggagggtgtatgcatttaggaatttatctatttcttctagattttctagtttatgtgcatagaggtatttgtagtattctctgatggttgtttgtatttctgtggggtcagtggtgatatcccctttatcatttctgattgtgtctatttgattctcctctcttttattaatctatctagtggtctatctattttattaattttttcaaaaaaccagctcctggattcattgatttttttgaagggtttttcatgtctctatctcctttagttccactctgatcttggttatttcttgtcttctgctagctttggggttttttgctcttggttctctaattcttttagctgtgatgttaggttgttgatttgagatctttctagctttctaatatagacatttagtgctaaaatttccctcttaacactgctttagctgtgtcctagagattctggtacgttgtctcttagttctcattagtttcaaagaacttcttgatttctaccataatttcattatttacctaggagtcattcaggaacaggttgttcaatttccatgtagtcgtgtggttttgaatgagtttcttaatcttgagttctaatttgatttcgctgtggtctgagagactgttatgatttcagttcttttgcatttactaaggagagttttacttccaattatgtgatcaattttagagtaatggcatgtggtgatgagaagaatgtatattctgtttttggatggagaattctgtagatatctgtcaggtccacttcatccagagctgagttcaggttctgaatatccttgttaattttctctctcaatgatctgtctaatgttgccagtggggtgttaaagtctcccactattattgtgtgggagtgtaagtctctttgtagatctgtaagaacttgctttatgaatctgggtgctcctgtattgggtgcatatatatttagaatagttagctcttcttgttgaattgaacactttaccattatgtaatgcccttctctgtctttttttatctttgttggtttaaagtctgttttgttggaaactaggattgcaacgcctgcttttttctgttttccatttgcttggtaaattttcctccatccctttatttttagcctatgtgtgtctttgcatgtgagatggggctcttgaatatagcataccaatgagtctggactcgatccagcttgccattctgtgtcttttaattggagcatttagcccatttacatttaaggttaatattgttatgtgtgaatttgatcctgtcatcatgatgctagctagttattttgcagacttgtttgtgtaggtgcttcacagcgtacttgtacttcagtttttttttggtagtagctggtaacagtttttcctttctatatttggtgcttccttcaggagcttttacagggcaggcctggtggtgataaatttcctcagcatttgcttgtctgaaaaagatcttgtttcttctttgcttatgaagcttagcttggccgcatataaaattctgggttggaaattcttttccttaagaatgttgaatattggccccactctcttcgggcttgtaaggtttccactgagaggtctgctgttagtctggcgggcttccctttgcttttctctctggctgcccttaacattttttctttcatttcagtcttggagaatctgatgattatgtgtcttggggttgatctttaaagggagtatcttactggcgttctctggatttcctgaatttgaacgttgccctgtcttcttaggttagggaagttctcctggatgatatcctgaagtatgttttttagcttgttccattctccccatatctttcaggtaccctaatcagttgtaggttcagtctttttacataatcccatatttactggaggttttgttcattccttttcattgttttttctctattcttgtctgcttgccttattttagaaagatagtcttcaagctctgagattgtttcctatgcttggtctgttcagctgttgttacttgtgattgcatcgtgacattcttatgttgtatctttcagccccatcaggtcatttatgttcctctctaaactggctattttggttatcagctcctgtaatgttttatcatgattcttagcttctttgcattgggttagaacatgctcctttagctcagtgaagttcattattacccaccttctgaagcctacttctgtcacttcctctatctcagcctcaacccagttctgtgcctttgctatagagatgctgtgatcacgtggagaagaggcactctggccttttgagttctcagtgtttttgtgttgattctttctcatcttggtgggcttatctatcttaagtctttgaggttgctgacctatgaatggggtttttgtggagtctttttgatgatgatgttgctttctttctattttatttttatttatttatttattttgagatggagtctggctctgtcgcccaggctggagtgcagtgtcgtgctctcggctcactgcaagctccgcctcccaggttgacgccattctcctgcctcagtctcctgagtaactgggactacaggtgtgtctgccaccacgcacagctaattttttttatttttatgttttcagtagagacggggtttcaccgtgttagccaagaatgtctcgatctcctgacttcgtgatccgcccgcctcggcctcccaaagtgctgggattacaggcttgagccaccacacccagcattttttttttttttttttttttttttttaagacagagtcttgctgttgtctcccaggctggagtgcaatggcaccatctcggctcactgcaacctctgcctcccaggttcaagcgattctcctgcctcagccccccgagtagctgggattacaggcgcccgccatcacacccagctaatttttgtatttttagtattttgtatatttgtatctcactatgttggtcaggctggtcttgaactcctgacctcgtgatcctcttgcctcggcctcccaaagtgctggaattataggtgtgagccaccgtgcccggctgtttttcttttaacagtcaggcctctcctccacagggctgctgcggtttgctgggggtccactccagacccttattgcctgggtccctcctgcacctggaggtatcaccagtgaaggctgcaaaacagcaaagatggcatccagctccttcctctggagactccatcccagaggggcaccaacctgatgccagctggaacgctcctggaggaggcatttgtagacccctgttgggaggtctcacccagtcaagaggaatgggatcagggacccgcttaaagaagcagtctggctgccccctggtggagcagatacgctgtgctgggggaaacctccctcatccagaccacccagactctccagagcatccaggtcccactgaaagtagcagtctggccatgatctgccacagcagctgtgctgcgctgtggggaattcctcccagtttggaccaccctgactcccaggagctggcaggccaggatggcctacttgagctgcagagatagtgtctgtccctcctacacgtccacccagctcggtcgtctcaggccgtctccaacgtctaccactggctggctggaattacaagacagtgagtcttagcttgtgaggtgctgtgggagtggggcccgctgaacgacggtgcttagctccctggcatcaccccaccttcctaggggaatagatggatctccttcctcacaggactttcttgggccggagtttgcgaaaactcctgggtctccgtgtgtggccacgctgccactgagagtctgcagagctctgtgctttagacccaaggccctcggcgtcttgggctcacgaggtgatctcccgatccacaggttgcaaagatctgtgggaaaagcgtggtttcccgggcgtggtctcacaatcactcaccgcctcccttggccggtggtcggggctcccctggctcagtgttgccccccgggtgggccatctccccaccctgcttttcctcgctctctgtgagtcgccccgactagctattcagtcccagtgcaagaatctgaatacctcagttgaaggtgtagaattcactcgccattccgttctccacgagcgctgcggattgcagctgcttctaaccagccatcttggcccgccttgtgtggggtttttttgtttgtttgttttgttttttaaggctagtcaagtgaagcagtgggagtggagaagaaacaaagaaatctgtaactggttgtaatcaattagtagtaaacaccattgcactcggatcagcctgtttgagggttttgtatccatcctatcccattctactttggcacagaatcagactacatgagtttttttaattagcattaaattttttttctccttgattcctttaatctaccaaaaggtggccatgaaaagactgtatatattagtgcaaatttgaaagtgattccagatcattttttaaatagttttgttttgctatttaagacatttcgcttgtcttctttgcagtcggtttcagagtatttattttcacggatattttagagcttgttcatgctttggttccttgttttttcattgcctgatgatgtaatgagaaggaccctgttgtgaattttcactttataaatttacatggtttgaattcttgtgtattgagctgcacaccatatcttttgctttcagttcatgtatgcacagattataaaataaataacaaaagtattccctgaaagttgagagtaagccacatcgtgatgaaaagttaagtttttgccagaattatatttccaaggccctgtgagatactctctaataccctcattttacagagcagggtgcaggctccgaggagatatgcattcacctttaatttgttaactgtgctcttccctcaggccccattttccttttctgagaagcaagggggcttgatgtggctcactggccttcacgcttgctgtttggactccaggggtagatgtgatatttggaacttaggggtagacgtgccttcctgtctggccgtcaccctccctccactgttcaccagctcagctctgccttcatctgttttccgtattggacttctggtaagattttgtccatgagccaaagcagaggcagttgggggagacttctacaggtaaaatgggagcttgaagactaccggtccacatggttatccaactctaagtgccatccagttgggacccgtccatcatgttcagtctggcacgcagcacagggccagcctgcgaaaggtgctcagtccttgcttgttgagtcattcaggtctcttctggctgtaactttccatgattcttccagccaagtggctgccaagccaagacccaggcaggtttcttcactcctgatctaggctctctagctctgtgacccattgatctggctacctcgaagaggtatggctgggcacggtggctcacacctgtaatcccagccctttgggaggctgaggtgggtggaccacttgaggccaggacttcgagaccaacctgggcaacatggtggaaccccatctctactaaaaaaaatacgaaaattagccgggcgtggtagcgcgtgcctgtaatcccagctgcttgagaggctgaggcatgagaattgcttgaacctggaaggtggaggttgcagtgagccaagatcacgccactgcactccagcctgggcaacagagcgagactctgtctcaaaaaaagaaagaggcatggaggatccaaagttaggatgtctcctggactaagaagccattgtcagtgcctcacctactccttgattttctaaataatgatagctacccgcccacagattctcccattattgaaggtatgtaaatgttcttagggatccaagtatgtgtgcatgaggtccttagcctctctgagctccaggctcctcatctgtagaaatggagataaagcctttgtcctcaggctgttgtgtaaagcactcagcccagtgcccgtcacccaggagacacacaatcaatggtggatattggtaacatacatcaaaagccttaaaaaatatgctttccctttgactcagtaattccacgaattgaaatttatctaaggagataatacagtacaagggtatcatggtagccctgggacaaagtaagtgtccaccagtaggagattcagagattatagtatgtatatacagtggaatgttatggagtcattaaaaatgataggctgggtgtggcagctcacacctgtaatcccatgcctgtagtcccccaaattttatgtggcatgttgtctgcttatacacatatatatgtgtgtgcacatatgtggaggaaaggctggaagggtacacaccaaatgataagaatggtcaggctaagcagaattgtaagtgaccatatatttttattttatgattatttttaatgaatatgcatttacttctataattctataaaaggcaatcaagacaaaaccatctctccattcacaacccctcttttcattcaccccttctctgctattctaaacatgatctctagttttcatggctcctccatttcaaaagccccgttgctctccgggtcatgttgtttccagtcttctagttcgcagctcctagtacaccaactctagatttgccactcctggcctgccagctgcctgttaggcactttaatttgccttctcagttgaacctcacaacactcccatggattgggtcattgtctgccattttcctaaaaaacagcgactaaagtagacattaagaagctaatttcctggccaggcgcagtggctcatgcctgtaatcccaacactttgggaggcagaggcgggtggatctcctgaggtcaggagttcgagaccggcctggccaacatggtgcaaccccatctctactaaaaatacaaaaattagccaggtgtggtggcatgggcctggaattccagctactcaggaggctgagacaggagaatcgcttgaacccaggaggcagaggttacagtgagccaagatcacaccattgcactccagcctaggcaacagagtgagactccatctcaaaaaaaaaaaaaagaagctaatttcccacctacccttttccaccccaactcctatgcatccttcaaaccaggcttcagtgacatcacctctaatgaccacgcctgccagcggagtcaaccctgttcccctctggctccctgaccctgggtgacagcctctgtcagccaccatcgcactgcactgtagttgttacctgggtgctgacctgtctgccccctccagactgtgagctcagtaagagcagagactgtcttactcttttctgtacccaagcatctggcacagctcttggcacatagtagagattctggaaccatcattcaagcagcaaacattcactggcctacacttcctcttgagttccagccatgactttgattctgattccttggtctggactggcatccagaatattcagcatctcaagcttcagaggacccaactgagcagggaggccacagaggcaagcgtcctctccctggacatgggaaggagaacatccagggacagggagcagtttctaggctgttccagtctgaccttggagggaccacaaagaagcgtggtgcggcagatggtgtgtccgctggagagggggctgccaaagaagaggagtctcttccctggtttccctcctccagtgttgtctccatcgacgctgtcctccaacgctgcagccacagatagtcatgagaaggcagatccgaccatgccactcttctgatgacagcaggctgctgtcacggtgggataaatgagctctgtcatgggtgtacagcgccattacttgcctgcacctaccccttactctgcaatcaggttgtttattccacccctaaaaaatattgatgtaaaaattttacatcagtattattgttgggcctttgcttttgccatttcctcagcttagcgtacccacctaggacctcctctcatctgactcacctttttatcctttcgactgagctcagataccaccccaaaagacccagtgcagtgccccaccctctgggacagaagcttcttgtgtccacacatctagcttagcaagtcccacgttgtatggaaatcatcattatggctccatctcttcccttgactctgaactacagtgaggtcagggactgactctcatatacctggatggtcccagaggctggcacagactgaactggaatgaactaggaaagagtttgagctgtatctgaatggcgtaagggtttgtgcgtggtaaagaccaaatccaagttgctcagggaacaggatagggccaggagggggaaaagaaaaaaaaggaactttaaaaaaaaaaaaaggttggtgagctccttggatcagaaagtaggtctgaaaccctgtgtgtgcctcccactcccagtgctagtgagcgtgccctgttaaattggtgagttgcttgacagctgaagtagggatgatggattagggatagggagaggtacagaaaaagaaggcaaagaggcattgttttgttcgcccaccaaagactgctgcttaggattgctaccgttgattgaagtttaatcaatactaagcatttcatttattccttcagtaaatattactgggtactcactgtacgccatgctggagaatgtcatagccaacccttatgaagtgttccctttatgccaggcttgaatagttgtccccgcaaccccacaggggaagagaggtggcgagaaagtacatgatttgctcgaggttgtgcagctggtgtgcgacagagccaggctttgacccaagcccccaaatccagagcctggatttttaactgctttgctccagttttgcctctgaagaagatcaaacaagacagcactcctgtcttcctagagctagtggaatttcttaacaggttaccattatattctagcaaattcttattatagaaaccagctggttatattcaccattaaaaaaaaaaattaaatcctggaggaatggtcctccagaaggcaaaggggaaactacatgtgtcctgaaccaagttcacacaaataatacccagcacatattcagctcatttccaggtctttttttttttaacttcctaatgtttaatttttaaaatttgttttaattcagtggatgcaaaatttggcagatagaaacaggatggagtgggttggcagtgatctacatgtgggaagaaaaaatgtagtgagaaaaaataattaatagttgggatctattcaaattcacattatgtaaggagggccctattttggttgggtgaatcatcttttttattaaaagggaaattatcaaaaagctatggctatcctaatgctgaattgggggaagcagcaataatattgatgtaaaatttctaagtaaaatactaaatacaatatgctcacaactctgggccgatagagccttatataaaaggcctatatggctgggcgcggtggctcactcctgtaatcccagcactttgggaggtggaggtgggttgatcacgaggtcagatgatcgagaccatcctggccaacatggtgaaacctgtctttactaaaaatacaaaaattagctgggcatggttgtacatgcctgtaatcccaactactctggaggctgaggcaggagaatcacttgaacccgggaggtagaggttgcagtgagccaagatggcaccactgcactccagcctgggtgacagagtgagactccgactcaaaaaaaaaaaaaaggcctataagaatcaggccgggtgccgtggctcacgcctgtaatcccagcactttgggaggccgaggctggcggatcacaaggtcagaagattgagaccatcctggtctaacttggtgaaaccccatctctactaaaaatacaaaaaattagccaggagtggtggcgggcgcctgtagtcctagctacttgggaggctgaggcaggagaatggcgtgaacccgggaggcagagcttgcagtgagccgagatcccgccactgcactccagcctgggcgaccgagcgagactccgtctcaaaaaaaaaaaaaaaagaatttggaaaattcaatctatttttaaacttcattcgatgtattttgtaaagaacgtatttgtaaaagacgaatatgctgtttgtggcagtaaataatgcaatgttttagcagaagcaatggcataataattgaacattcatgtagcactttagagtttagcaaggtttttgttttgtttgtttgtatttttagacaagatctagctctgtcacccaggctggagtgcagtggcgcaatctcagctcactgcgacctctgcccactgcgacctttgcccccgggctcaagcagttctcccacctcggcctcccaagtaactgggaccacagatatgtgccaccacatccagccaagtttttgtatttttggtagagacggtttcaccatgttgcccaggctgatctcagactcctgagctcaagcagtccacctaccttggcctcccaaagtgctgggattacaggcgtgagccactgtgcctggcctagtttagcaagtatttttacagtttgagttttcacaaagacttttagcccatgtgcaactttgctcttttatcacaaggaaatgaggcaactaaaaggaacttttagttccatggagaaacagctgattttagagcaaggacagggaaggaacaacggaagcttggaatgagaagtgctcagactatgagggggacatgtcagaaggtcatgggaacctgcttgacggggctccccatcacctgggacaatttgaagatcaaagtcaatagtattagtaatggattacaacctcttgaataaagtaagaacccatgagtctctactaatgtaaatgaatgaataaataaataactgggagaggaggcagaactcctccttagaaagctgactaatgaatgcagagggaaggatggagtgagaaagatcaccacttgccagccatcatcacaatcactcattcaggccagaatcattagtggaattaaaataaggccgttgaggtttgaggggtaacatgtttacatagcctcagagtacctccctaacaagacacttttcattacaaaagataaaatggtaactctccagtggagagacctggcaggtgtccccttaaccagatgatccccggtgaccccaccagcagtgggactcatgtgcccaggtgggatgcagtgacattaactcagcaccccatctctgtgtccctgccaaatgtgttttacccaagctaatctcaaggaagcattaaaccacattacaagaagcagccacataactggaggctaaatataactggaggctaaatataactggaggctaaacatgcaactgaatgcaatctatgatcgtggattttcttttgctatgaaggttattatttggacaataggcagtatctcaataagtctgtagattagtgttgtttcagcattaattttctaattttgatgattacactttggttatttaagagagttcattgtttttaggacatacacactgaagcattttggggagggaaggatgggaggaaggatttcccaggaagggacgctgctgtcataggactcagaccacagagttggcacctctcggcacaggcttccatttgaagggaaatgggccacggccccgtcaagcctcagcagctccctgggaagacatgaggggcagctgccttgcctcttcccaccctgttcctctgtctgtttgcgtaggctgtttccccctgaaaatgccctcttccctcctcacctacctggagaaaggccagctgggaggtttcaaggaaggagatgtagatggacagttcagagccctggcttctccttctcacatagctaccaacaagagagggaagtggagagtggccatgggatccctgcagaccttggcgtcctcccctgcatgatgaagggcctggaccagctggtctttgtggctttccagccacttcctacaaacttgtccctctcagactcatcagtctcagcttctctgcaagcccctagaaagcctgcccttggcctcaggaaagaagctgtggtcccagccctgagagattgacttttggatctcctttctggtgtaggtggtgctgtgagtggatcatatattcagacttttaggacattgcattgatttctgtggacactaggtttttcagtaaactcacaggtgtgcagtttgcagacagcttgcttggcagtttgctggttcattctttcctgcgccatgtgtatgaggaacctgccatgtccaggccagtgctaggcacacagggtcagctagacacggcaagctctagagctgcagggtgtaccttatagtcctgttggaacagttttgtaaagtcagttttcgttgtgatgagagagtggtaggcaggagaactagaagccccagcctggttcactgttgattgtatgaacttgtcttaaccagataacctctctgagtctcagtttccccatctgctaaatgggcatagcggtctcactctcctgcccatcctgccctcctcttagagctgtggcccttaaagggaataattttatgtagtgctttatgaatatgaggtggtcttgttgttaatccctcaacatgcatagataaaactgctttgaaaaatgtagggtcttaaacacaaagagagaatggcagtattgtctctaccctctactgatcttaaaagaaggagtgctgctaggatgcaatggtaaggaatcagagaatcaagctgtggcttgttatggaggaagcccatggggccgcctccctctgcggaacatatgtctgtgctgtgtcagcccaaagcccagaacctggtccttagcaaggggactgactatggccttgtcattccagtgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggtatgtcacacctgctgcataacaggtgagcgggttttggattttatagctaagggggaggagagctgtccctttccaaaagcccttttctgatctttgtgactttgctcattctccaaaggatgtgatttagcataaagaactctcttacatattatagaacttcataatttgggtagatttaaagttggtaatagttgaaacagtagactatatgtaaccaatatgatgaaccattgaaaataatttcaaagtcttatttgtaaatgaaaccagtttttaaatagtttcttttttttccaaattgagggcgtaagattctgtcaatgactttctttcaatttaaggagcttagcaattcttatgtcataaagaacaatgttaagatacagatcttgtaaaatacaattttaaaaatcatatcatttacagtttattttatatattatttattagttatctattcctccaaaaaattacccccaaatttagcagcttaattatctcgcatggtttctgagagtcaggcatctgggagtggctccattgggtggttcgggctcaggtggtttgtgaggttgtgtgaagatgttggtcggggctgtggttgccgacagctggactaaggtggagactcacttccagggtgccctgttcacgtggctcttggctggaggcctcagttcctcaccattggacctgctcacaacatggtagctggcctctcccagagcgagtgatccacaagaaggggcagaggcagggccatgccatatttcatgacctggcctcagaggtgacagtccattgctcctgttgtattctgttggtcacacagaacaaccctgatacacagaggaaagagactatagaaaagtgtgactatcaagaggctggaatgatttgggactcacttggagtctggctcccacagcttagtacttttgatgtctatttttatgtaacatgtattgaacataaagctataaactgaagtcacatgacatattctacaggctggttatagtggctcatgcctataatcctagcactttgggaggccaaggcaggaggatcacttgaatccaggagttcgagaccaaatggtgagacctcgtctttataaaaatagaaatacagaatcagctgggcatggtggtgcgtgcctgtagtgccagctacttgggacgctgaggtgggagtatcgtttgggtgtaggaggtcaaggctgcagtgagctgagattatgccattgcactccagcctgggcaacacagtgagaccctgtctcaaaaaaaaaaaaagagagatattcagccaggcatggtggctcacgcctgtaatcccagcactttgggaggccgaggcggatggatcacctgaggtcaggagttcaagactaacctggccaacatggtgaaacctcgtgtctactaaaaaatacaaaaattagctgggcatggtggtgggagcctgtaatcccagctactcggaaggctgaggcaggagaatcgcttgaacctaggaggcggaggttgcagtgagctgagaccatgccactgcactccagcctaggcaacagggcgagactgtttttttttctccaaaaaaaaaaagatattatataaatcctatttttatgatcagcataggtttctcccaacccctgccttgtgctcagtttttccaaaagcaggttggtttgcttttttttataacccttgtgaaactggatatactctagataatccacaaactgtaacgtctgtgtcagttttgcgtttgataggacaaatgttattactctcctagattacctacaaatctagtatgtcacattgcacttgctttttttttaagatcaaaataaatttatcacttatgtattctaccacattaaagaaacaaacaaataaaaaccttttactcccaccatcctgtcacaaccattattatttttttctttttcttttttcttttcttgagatggggtctcactctgttacccaggctggagtgcagctcacttcagccttgacttcctgggctcgagtgatcctcctgcctcagcctctgaaagcactgagattatagatgtgagccaccttgccctgcccattattattattttagagcacttctttctagtctttttcaagagcttattcttataaggtgcttatcaggatatccatgtcgctctctagccttttgacttcttaaatccagacaaggtaggctttgtgttgggttttctgtcactcacatactgctgttgggagggaggaccttcagcagggctgggcacacactgtccatccctctctgctccagagcaggaagaggtggatgtgggtgtggggaggaggctggaaagcaggaagcctctggaacagacttggactcatcaacagccttcctgcttagatgcaggagagtagtcaccccagccatgtgggattaaggcttggggatagaggcacattctctctgggtacgtaggcccctgcacataaatctgtgctcaccgaggagaccacacttagtttaatgagacgccagagcacacagtgggtggcacacacagggactccagagcacacatgggggacaggcaggcagtgaggtggaagaagcccctaacgtggtcgctgatgtgggcaatgctaggaaccagtccccagccatcaggggctccaggtgtggaggaccccacgatacaggtgtgtggccccactccagtttctgcgctaaaggcttactgaatccaccccacacactgtgtgtggccatttaggcagaattagaccagaagaaccaatgtgctttggaatctcagaaggcccccaaaccaccaaatttgaccttgcttcagggtccatctgccatgcatggcattaacacagaaatgttccgtcagctcatgcaaagcaagcagctatgtcactgcagatccgatcttgcttctgcccttaagtgatgttttccatccatatctctgccacctcattcaccaaagtttggccccagatggcttgagtgattaaaaaattgagcctgccatagaggctgtagatttccgatccctgaggatctgatcctcttccactgcctgcccagcaacctgcatgccatggtctgggcagaggactgctttgcagggaccagggctcacatggatttacctctaatgggttttcattacaaatagatgatgctgtagtcacaacccacacccatgggaggccacagctgggttacagtgaaagtggcagcattctctgtggcagggccagctctgcgttcaccctggcagggagtgctgtttgcttactgattggctgcccacaggggttcccaccacgatgggtgcatatcgcatgttgttctcagtgtaggtgtgaaatgtcagagctggagctgtgacatctgtgagcacctggaggaattagactgatctcaggcccatacagccccctccgcagctgtccctggcagagaaatggacagagaatggggaggggggttcctggatggtgccgcagggaccatggactccaaagcaaatcggggaaaggacaaagcagtggagatgttgtgggagaaaaagatttattatttacctgtcaggtgcctaaaggtaatgtcagctttatctttcccctgtataatttgttgacatttagggtatggcaggtgacgatagtgtaccaacaatttgtgcgtggtttgcaaatggtatgaaagaagtgtctgcgtgttgtttcctgtagttgtatctttccaaggaatgtaaggttgagaactgatcctttggctctgctggaacatccagcccctcctgcactcaccccactttttttcatggatagattagggggtcttgattatccagatcctcattctggctttctacttcacactgccctgctggacacagcttttatgaggaattctcagcagtaatctgtaagaacttgacaacccctaaactgtttgctcttctccctccaggatgggaaggtgatcgtgtgggattccttcaccacaaacaaggtgaggcattgttcccagccacgttatagaggcttcagaatcccagcctacttaaaggtgctctggtccagctgcccggccctgtcctgatttctctccatgtatccctgcaagcagttgcctctacggatggaaaccccaagaaggcctatccgtgtttgaacagctcagccagcccattgcagcatttattcccctctcgccccaagaggacaattagagccaccataggggctgccaataccaacatggaaatgggcaaagcatggaaaacttgcaaccacatgtgcaactgcatgtactatttgtcttctgagtgataagaggcaccaaaattctccattctctctcccctctctttgaccagactccatagccctgtgggaatgaacacgtggagggtggggaagatgaggctgcagtgggactgggcagagctaccctgtgatgcagtctgatccccttgcaagtctggcttgggcatgcacagctcaacttagatttaaattttagctcttaatgaaaataagaccaaaacctatgtgcaggtatgctggaacacctgcattgcattggcatttacaataaagagtattgtgtattaaataagaattcctatatttatttagaaagccttcctttatgctatgaaaaacatgagacctgtctctgtctcatagtgaacagcagccatattctgcattgttgaatgtgtttagtcagtgtcatgggaagcagccggtacatgacctggtcaagtgaggggccgaaaccattttgtagagtcgagtccctaatggtcagtcccctgaggaataaaaatgacagcaatctgcacagggctttgctatacagcgcctagctccttggaagccttcatctctctcagcaccttctggactatgcaggggtgtagttgcttctgtttccaccttatcctggcatagagcacagactgatttctggggagccgagggtgccacttgtggcccgtggcagggaatatagccattacttgtgaggaaaggggcctgggataccctgtgctgagagtggctacctcagctcgttctctggagagcagtagattattcttggcctctgaaagcctaccaggctgctatcgacaatagtatttgggcagacagtattggggcctgtgtttccccacaaaaacacatgtaattataacagaaaagaagaccagcacttgaatgtacattggaagcattaagaactaagtgcgcccatccctggctgctggctggctgagtcacccctatcctcctgcatgcagatatgcaaacaacagagccatgtttccaacacatctgagcctgaggttttattcccatgggagacgtggaccctggtcctggttctaccaccaccaagatgtgcaaccgcacacaggccagccatgtgtgccacggtggttctcattcttcctctgtgaagccagaagccagggactgttgtgcttagttcttaatgtttccattttaccagttctcattatccgtgagcacaacccaagatcaccctcccctcccctgacccattcataccttccctgggatggtttagggctcatagtggacacaggctcttgcagattcacaagtaaacagacttaaaatacaaatataaaaagtcattccagagtatattttgaaaatggaaatcagagtaaataaggaaaagtatatatctgaaaggagatttgggcataccttccaaagaaaaggggccctgataggcagaggaacaaagggagtatgacattaaggaggaagtaaaacatgaaaggtttttttttttttgcttttgctagttgagctttttaacttttcgaatatgtgacatcaagttgattataagagtcccctcataagtcttgagcccatctttaccccgtaccacttccttttgaaactataatgtaattcagtaggcatctggtgattttattttctaaaatttaaacattaagatttttgtggctgggcatgggggctcacacccgtaatcccagcactttgggaggccacggtgagcagatcacttgaagtcaggagttcgagaccagcctggccaacatggcgaaaccccatctttactaaaaatacaaaaattagcctggcatggtggcgcatgcctgtaatcccagttaggaagctgagataggagaattgcttgaaccccggaggcagatgttggagtgagctgagattgtgccactgcactccagcctgggcaacagagtgagactccatctcaaaaaaaaagaaaaaaaaaaaagatttttgtgtggaagtgctagttgttcactctgtgctgtgtttcaggagcacgcggtcaccatgccctgcacgtgggtgatggcatgtgcttatgccccatcgggatgtgccattgcttgtgggtaagttggagctacagcagcttttcagaatttgtgttaaccatagaatactgttctcttggcaaaaacaaacaaacaagaactcacagtttttgttgtttaattgtttagcagtatgctaaatccttccctgaacttgatcaaagaagaaaccataagccagcacagtggtgcctgcttgtaatcccagccacctgggaggctgaggtgggaggatcacttgagcccaggagttcaagtccaccctggcaacatagcaagaccccatctctttaaaaaaaaaaaaaaaaaacaaaaccataaaactctctttcataattattttcattacaaactgacagtagttacatttcaaacctatctcctgctctctcaaatgcttttggcagaaccataaacgttgcaaacattttggaaagcaacttggtaatgtctgtcagaagccttgaaaaatggatagcctttgatctggtgactccacatccaggaactcatttgaaaggaatgatccaaaacatagaaaagccatatggacaatgacattaattgtagtatttttaaaaatgaagcaaaaagtaccaggcgtggtgactcttgcctgtaatcccagtactttgggaggcagaggcaggaggatcacttgagcccaggagttcgagaccagcttgggcaatgtgataataataccttgtctctacagaaaaaaaaaaaaaaaaaaaaaatctaattagctgggtgtggtggtatacaactgtagacccagctattctggaagctgaggtgggaggactgcttgagcctgggagattaaggctacagtaagctgtgatcatgccactgcagtccagcctgggtgagagtaagaccctgtctcaaaaataaaataaagcagaaaaggaaaggaaaaaggaaccaacatacccatccaagaaaacttaagtgaattgtggtacacgaattgaatggaatatcatacagccattaaaaaggaaaattctcaattacactgtgtgaaaagggcatcaagattactaggaagagtgtgccttattccctattctcctggagctcagtttaacagggttaacaatgagaactgaaaccgacataattcccagtccctgtgttgaacaactctgagaccattcaaaatatttctgccacagtatctcagccatgtttttaaaaagaggcatattaggccgggcaagtggtggctcacgcctgtaatcccagcactttgggaggctgagactggcagatcacgaggtcaggagatcgagaccattctggctaacatggtgaaaccccgtctctactaaaaataaaaaaaaattagccgggcacggtggcgggtgcctgtagtcccagctactcgggaggctgaggcaggagaatggcgtgaacccaggaggcggagcttgcagtgagccaagatcgcgccactgcactccagcctgggggagagagcgagactccatctcaaaaaaaaaaaaaaaaaaaaagtcatattataaaggctgggaggaactataccaaataaaatagtagttctttctggatgatgggactatggggatttttcttcttataatcaggaagaaagaattttattttaaagaggaaaagcccgagtccccaggcaaatgctttggagccctctccagccagtcacaccaaccatcttctccagtgtcccttcccttagggtggctgctttggggacatagtctcactctccttccagtggccaagaccacttgtccctttggagcccatgttcacatacatgtatttcactctttttattttttgagatggagtctggctctgtcacccaggctggagtgcagtggcatgatctcggctctctgcaacctccgctccctgggttcaagcaattcttctgcctcagcctcccaagtagctgggactacaggcgtgcaccaccacgtctggctaatttttgtatttttttttttgcagagatggggttttaccatgttggccagggtggtctcgaactcctgacatcaagtgatctgcctgcctcagcctcccaaagtgttgagattgcaggtgtgagccactgcacccggcccatattttttaatttttaaaatagctcaaaagtggattgtgtctccactttatagatggatgccagtatttatataaaatttattaccatctacttcctaaaaggataagaggtgctataataaaagatatatatgtaaatatatatatatttgtactacatgtgtaacacatctattagagaaagcaagcaagagagaaataggccacaattataaggttggtgcaaaggagtttagccaactccagttagaaggcacagttccaagactgccccttgcttcagatactggctgcaaatttgagggtccccacaaccccaggaattcactaaaacaactcgccaaactcatgaaagtgctgtacttactaccacagttttattacagtgtaagggtacaaattagaaccaaccaaaggaggagacccctggggcagaagccaggaggcatccagacatggagctgcgagtcatcgtctccctggtgtggtcactgacggcgttgtttcctcttggccacggtgtatggtaatacatgcagagtattgccagctggggaagctcctctgagccttaggtgtccagaggttttattgggggcttgaccacacactgcctgtgtggtttacctttataaagtcttcagtctctagaagttcgggcagatacctttagtctcaagttcctctggagatcagacctgatatgatgcatccaaaagcccccatcataaatcacattattaaactggtggccagagcccccaagcaaaccaagccactcttaccaggcaggacattccaggggcccagagatcacttccaagtagctgagggcaaaagccagacctctgctgcagtgtcagttcttcactactcagtaggaatcgtaagttctccacatttttttatatcctagggtaatatgtttctagttggacatgaattttagcagatgcatagagctggatgtgttacataatctgtcaatatccaatattgaaatattagatatgcagttctaaattacagaaagaatatattgggtaggcccttctgcaatgtgtagtgaatatgataacagtgaacaatgtcttcaacagtagtttaggaaatgatgctgtggctgtttcttaattttaccctcactaaatggaatgcagcggaagaattcccatgggggtagcgggacggaaggaagagagcagccttaccaggcccggatagatagctttctggtgactcagcgtggtgcagaacagaattcagagtggagggatggctggcgccctgatctttgtcatctctgtttccccaccctggcatgtgggaggtgctagcacctttcctggctgcctcactggctgttacgagggccaaacagaggaagttcaaggcatgaacatttgtgaaggcatttttcaaaatgtggcggtctagtggatgagagagcgtcaaagacgaaactaatactgactccttatcgcaggtaaaagtaccatctccccttcccagacctttcccaaaactgctaagagcagctgtgattcatttgagtttctagtggtaagtctgacataatgtttcccaaccatgactgtgtgacatccctgtgactctgttatctgtaatagacccacaccgatgccacattctctaaaagtcattgtaggtaataatggggatattttttatctcaatttacctggctcctgggtctccctctcagttgtttccaaacttgaaagctaaaacccaaatggtattgccacaatcccctttcccccaaaaatgtgtcaattggttatatatacaagtatttcttatttaggagccatatccccaagaagctttcattcaggtattgtacacttactatgatctcatgtgtgcaaggcactgggccaggtgtcatactggaattcaaagatgaatacgtaaccaagatcacaacattagttaggtactaaagcagagattcgacactggatgcatcaccctgcaaaaccttcctgcttctcatagcaatgcgaataaccctaagtaataagtatctcaacagagaaattactcaggatggggaggatgtatcccagctcaggggtcagggaggaccatagtccacagcatgcttgtccccttaccatagcctaagtgcaaatcattctctacacattctgttttttttttttctcttttttttagtcaaagaatctcactctgttgcccaggctggagtgcggtggtgtggtctcaactcactgcaacctccacctcccaggttcaagcaattctcctgcctcagcctcccaagtagctgggattacaggcacctgccaccttgcccagctaatttttgtatttttagtagagatggggtttctccatgttggccaggctggtcttgaactcctgacctcaggtgattggcctgcctgggcctcccaaagtgctaggattacagatgtgagccaccgtgcccagcctcctccgcacattgtataaacaagtttgccaaagctaattactgataagaaactacccaagaatacacctgtgtacctcccaagcagctggaaaagcagaagggacccttggctttcccagtgcctcagaaaaaagtgaccccattttaaatattgttccctacaaaaagaaagcagggcaccttagggtaaggctgaggttaggtctttgggaggaaaagaataaagtgaggctaggatattttcttgttctagaaagtaaaggaacgttcaaggaccaataggggtcatacatatattaaaaaaaaaaacacagctggcttgaagaggccccaaatttggggtaatttgagcatcaaatgtagtaatgataataatggatcatgatacaattaagaaaaaaaaacaaatttatgggtgtacagtgatactgggaaggaggatttttcattacagaaaaacaccagctaataaatacggaagacattatcaaaataaatcacccttttgcacccctaaagtaatatctgattcaagcaaggataatcatgtaaagcctttgtatgaaaggtggttggagaaaatgatatttttatggtctcaaaatatcacaccacagattattactgattacaaacaaattacctttaccctggagatatctagtggtccaccttaaccaagtaatcaaagttggctttaccaatcttggaagagacattacaagccttgtgacatgaagcaataagaaagaagtacacagtagcaccttgatactcttattggcaaaatgttctacagtactttaaccattaagaaaccatctgacaaatccaccatatgcgacattctataaacagccaatctaagatttcctgtcatgaacaacaaacagtaggtagtgtctgttctaggttaaaagatcttaaaaagacataacaaatgaatgcaatatgtgagccttggttggtccctggatcctggcgacaatcagggaagattgaatatggctggcttattaaatggtgttatggaggttttgttgattttctcaaatgtgataaggatgtggtagatagacaggagaatgttcttatttttaggagatgtaaatttgcaagtggaagtgtttagaaggaaaatgtcatatctgcagtttgcagtcaaatggttcagaatttgctcctgtagatatgacaaaatgttaagtctgtgaatctaagggaagggatctgggtgttcagtatactattttttttttcagttttacagtaggtttgaaaatcttcaaactggccaggcacagtggcttacacctgtaatcctagcactttgggaggccaaaggaggattgcttgaggccacgagttcgaggccaagagttcaagaccaacctggccaacagagcaagaccctgtctctatttaaaaaaaaaaaaagaaagaaagaaaagaaaatcttcaaagtaaaagttggaggaaagggtacaatatatgatactgctaaagagaatatgttgaaaagttcatgtgattggaaaagtagacacatattctgtgactctgcattaatctttggtacttctttctttccatcctagtggtttggataataagtgttctgtgtaccccttgacgtttgacaaaaatgaaaacatggctgccaaaaagaagtctgttgctatgcacaccaactacctgtcggcctgcagcttcaccaactctgacatgcaggtaaataggcagcccccggtgtcaggttgacctgccaaggagcactaaagaggagctgagaggagaggaagctttcggcgtctctctgaacaagatggctgtgctccagtagtttgctctaagaggaagctcctattgtttctcattagttattattattttaataacatgagaaggttggggctagtgattgttggtagtgttgagataaaactgcatggcatattgaaaatcctcctctgattgacttggcgagggtgggagtggagcagggaaccccctggggtgcaggcagttactgtgccctggtctgcgtgctaacgtgtgtaaagcttcactgagctgtcgggcttcagagctgtgcactgcatgcatctcactttacagtcctgttttaaccaatgcaaaaagaaaatgcttcaccatattaaatctttgctctactttaaatacactacagtgaaaacaacacaacctttatcactttaagttttctttagcaagtggtgaaagcaccgcatcgtttatttattcacacttattcagcaaaccttctcagtacctactacccatattgccagataccacgtggctctggggccaaaagctcagtcttggccctcagggaccttcatgaaaaccaataatggttggacagtgggggaactggggagctccgagcaggaggggttggtcacagacttgctgctgccagtgaagagggaccgctgccactccaggcggccacagagtgtgagggagcacagtgggaggcaggcagccgagaggtgggtggggccagatcccagggctccctgagtgcctgggctggaccctgtaggtgacgggagcccttgcaggggtgagtcagattttggtttgtttaaaagagaaaagtgtctgagttagattaaagccttccatagtttactctggcttcagtgaattgatgtcaggagggatggggaggttagaggcagggaggtcaggtggctgggtaattgttcaattgctgactggagggatgttgggacttgcagtgtcaccattgtgcccctgttgtttacacctattatttgagcctaaccaggaatcttgcagacttgttcaccagggggcgctgtggccactgactggtgcagtggccaaaatgagatgtctttgggcctgaggcaaaccaaagcaacagaggacatttaggctggatgaaggcaggctcagggggctaccacgaccatcaggcatctgaagcccctctgtggagacccatcagactcgctctgtgttgccccggggcagggttggggatgaaagggggcaccagtaggtgagaaagtgctttcttttccaacaagcagcttagccggagataaagggaagtcacagctggctacctcggcggggacgcggcctgggaggcagggtaggtcaagggtggctctggaggcagacagcaggattggatcttggctccgctgtgttctagctggtgatcctagacagcgtttgaatttctgcgtgcttcatttttctcacctgcacatgaggatagtaaagtagtaaatctgtcctgcataaggttttctgaggcttaaattagatgattcatgtacatagtgtagtccctggtaaatatcagtaagcgttaactcttattatttgtttgtttgtttgtttgttttttgagacagggtctcactctagtacccaggctggagtacagtggcacagtctgggctcactgaagcctccaccacccaggctcaagtgattctcctgcctcagcctcccaagtagctggtaggcctgtagtgggtctgcaagcacacgccaccatgcctggctaatttttgtattttttgtagtgatggggtcttggtgtgttgccctggctgatcttgaactccagagctcaagcaatccacttgcctttgcctcccaaagtgctgggattataggcgtgagccactgcacccagccaattttattattattaacacaaagcttcatggatgatgctgatacatggcctagtttgggtactactgaactcatgaacctccagctttcttcaatccctgggatctaggttgataaaagagaaactcaagcggctggtatgagactatggtattaaacttacaaattctctgcattccagaacaaatgagtgacaatgagttaggggttctgtttaatgcatttatatgaataaatgtttggtctttaaactttatttttacttatattataatgaagatcagaaacacaaaattgaaaagtattagaaatctacttttaacttttaaaaactattcatttctttgatcaaacagtatggtatgaaaatttcctaaattaaagagcaagactggggtagttgcttaaagaaaattgtttggacctggtgtctcaaaataaactgtaagttactgcaagtgttattaggaaagcagtgagttggaacagccactagtgggtgtgggccaggagagattgagggaatttgagcatccaacaaaatatgagtacccaaatttcagcctcggttcaggttttgtgtgtccataagctactttgctagcttaagtcatcttgttggatgtatgcaggcctcctgagggaagtcaaggctggagggggtcctgtggacagccagtgggtgcaacaccagggcgggagcagattcccctccttgtaatttgttccttccctgcaaaaaaagaaaaaaaaatgagtttttttttttttttttttgagaccaagtctcactctgttgcccaggctggagtacagtggcgtgatctcagctcactgcaacctccgcctcccaggttcaagcgattctagtgcctcagccttccaagtagctgggacaacaggcgtgagccactacaactggctaatttttgtatttttagtagagttggagttttaccatgttggccaggctggtcttgaactcctgaccttgggtgatccgcccacctcagcctcccaaagtgctgggaaaaaaatgagattctttatgttcaaggcctaacatataagagagaggggaagaaaaagggaaagggggcaaagggtgaggaggagagatcccatcagcagctggaaattgaaggtgtggtgtggtcagtggttgcattgcatgctagcggtgcataaggcctgattcctcttttctttcctcagccatcagtaatcatccgcaaagggctctcttgtggacacttatgctgcaagagccacttcctccacggtcttatcacctcacccaggccctgtggagcagccagaaggcagggagagcttctcccttgcaggtcccctccattgctgtcagtacccagctggctccagggctctgtgatgccgccagctgggcctatgagggccccgaaccctgagtcctcactgcctttctcccaatcccaggaaggtatgctcagccagagcccaggcctcatacacactggcagtgacaaaaagtaaaattccagccctgtccccatgtctttccctgggcacccctgtgtgcctttactctatggctgacctttgtacttgtaagctatccagaggctctttgggcctctgccagagtttcctaaaacatacgtttgcttttctcattctcctgcccagaagcttccagagtgctctcttggcttcagactgagtccccacctgtgaacgggctcacctttcatttagtgcagacataggcccccctggagtttgtctctccccttcccttctttcacctggccagctctcactcttccttgaagaccaactcagatatcaccacactgggtttgggaccctcctgtgtgcacacctggatcccagcacttctcatgctgttgtcattgatccttgtctactggtgatgtcaactccccaagcgaacatcagaaatacttgcaaccaagcaaagctaaggttatctgacctgccacagtaagggagaacctccacttggcagaatcttagtaggttctgaaaatggaggaattagggaagggtacttagaggatttcagggtccaggcttggtgattttaaggtgggtcttgcaaggccgttttagctttggattggtgagcccagcaagcgaacagtctttgagtctggatgagcaagctgttaatcttggtaagttgtctaatcgattcacagtcttttctcccaggagcaggtattttctgcagcaagcagttaagttatttttacttggtctcaatatggtttaacatagtaacaggaaagttggcctggtcccagaattgtttaacacagggatggggaattatgttggtttcattcttactggcaatcctattaaactgagttctgggagaacagaaactgagacacaatctttctgcaaaccctcatgcattagcagagtgcctggcagacactgtcagcacacagcagatgtttcttgaacctgtgtatgcgtgaatatcctctggcacccgtcagtggtcctgggaagcctctgggcagcactgtgctcgggaaaagcagcaacagagaatgtccaacaagatgctgcctagacccctgctgctcccagtgtgccccgtgaccagcctcagcattccctgggagcctgtgagaagtgtagacgctcaggccccaccccagactctattagcaagcagcccagtgatgtgtatgcatcagtatccaagaagcactttaagtttttggcctgcacagcagtgggaggcatcgaaggttttaaacactcagtagagactcacggaacacttcctacgagccaggcatgtgtagagccctgtaggtaccaccatgaggccgccaggatttcagctctgctgggaggcaggcatataaacacaactcaaggactgtgagggtaggaaatgcactctttccttctttgtatagaagagagatttctgtgcatgaacccagatacagcaggtagggtgtgtgtgtgtgtgtgtgtgtgtgtgtgtgtgtgtgtgtgtgtgtgtgtgtgtgtgtgttttctgcttttccctgtgtgtgtgtgtgtgtgtgtgtgtgtgtgtgtgttctgcttttccctgcaaaacgttaagcctctgattgactgcccccggcataagcaataaccacaaccatataaacacaactcaaggactgtgagggtgtaggaaatgcactctttccttctttgtataggagagagatttctgtgcatgaacccagatacagcaggtagggtgtgtgtgtgtgtgtgtgtgtgtgtgtgtgtgtgtgtgtgttctgcttttccctgcggaacgttaagcctctgattgactgcccccggcataagcaataaccacaaccacccacttcctgtccttttctgcgggcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctggggtaaagacccagtggaaattccctagggctcctgtgtccactaaggaggcttatggtggcagttcttgtccattcatgggattagcctaggcacttccctagaaggggctgcaggaattgttctcaactccccactaaacccccagctcctgcagtgaccgcactggctccaggcccctctcgggggcttggtgggcagctacagggctaagctgtgagggcctccttctgttctgccactgatgttagcagtctatagagtaatctggaatgttctcctgtatgagtgctgcaactcaaggtgcatatctgccacattttaaaatgtcattcctcaagtaaatagcagagagttagcatctgagagcatcagagatgcgcacaagggcatggcaggtcagatggctactgagctgaggcaacgctgtgatgccaccaggactttgaggcctgtggggcactctcctaccctacccctgccagccaccatcctccctcccatcacagggtgcaagaaacagaggctttgaaagctcagaattggcagacagggccacagagactcagagaagcactagactaggagtcagggtgcctgggtcagggctttgctacctgactgtaagtcgcatccgctataagttggccatagtgcatagtggtatttgcacttcccctccccaggatggtacaagcagtagatggaagagtttgcagtgtgtatgcaaatgggaggggcaagtctttctggggccagcctgagaataaggacagagagctgggccagctgaccttaccatgggtcctgtctcacctccgtcaggaggcagtggtgagacaggacagtgacgcacacactgtcaggtgacttctgcagctgggacacataagggacctttgctccaggctgcccacatatcgatcctgggagccaggccagggctgtatgagctgtagttagcagggaccctgattttcttcctgggtatttggccatgtgtagatgtttcaaccctgtgccttggtatcactgtatttatctctcctcaactctactgtgtttttaaaaaattactgctattactgtagatcatattgtctctttcagagcactaaactgcatccaattgagtgtcctctaaagatgtgaaggcctttctggtttctttgcccacattttcagtaaagacactcgggatgctgaactcccacagcgggccttcctcagatgtgtgatggtgcttcattacacacctccctctgctccaagttgaaaccaacaacttagacaccagttttaagctgttactttttagctgtttgatcatataagctatttgactattgagagtccacattctactacttaagcttgataacatgaccactctgcaggaacttatcaaactactcccagagccttgataggataatggaaaaaccctcatgtctgtgaccttctgggtcatgttagcaacctgaagagagcattgactttataggtgttgaggcagacgcccagggaggtgacttgcctaagccaccctgcgcgtcgatggcagcacccttatgggcccctggtttgcagattcccagcccagcatgctgctgagggtgcagatggcccggggcacctggctctccagctttgctgagggctgccccatacaccaaaacaaagctgggactctcggctgctccatttgggcactgccaacccatttattaatgtcacaactagagaggtcccaccacacaccactgcctgcctgccttgccctctgggcttagggaggcaagtataaagagaagagagaaaagaaggaaaaatgaaaggaagggagatgcccgggggagggtaaggagggtttgcctccattcagaaatgtgcaaaagaagaaaacaagctaaaagaggaagccgagtgccttccctcctgcctcccatcccaagacctagttctaggcgtctaagggctttctgactaaggaaagtgccctcaggtaaagctagtctcagaaaagtgtgttgtcaaccatttgctaatgggaaataaatggtctgtgttatataactgggactcgtgccttgtctatagacattccttaaagtggccataactctggctaattttcatttgtagggatgtgacaagaaagccatggtgtgggacatgcgctccggccagtgcgtgcaggcctttgaaacacatgaatctgacatcaacagtgtccggtcagtgagtagaatgttcatgccacctctctgttctgccggcattgcctggcttgggtaatccttagcccaggaaccgcctccagactcagtttacttggctgagagaggcctccccgggaagaaaggctgattgtggtggaactgaacagtgctccagaactcatggagaattttaatttaattacattaggagcaattaatatcctccctaagttgaatcagcatttttcatccattcattcaataaatatttattaagtatttatatgctagatattattctaggaactgggaatatatcagtgaacaagatggacaaggtctctattctcttacaggagacaaactagaccaaacacaaatatacaatttcagatactgataactactatgataaaagtaaaacagggagatgggatgggtcatttcttagaggtcaaagacagcctcactgagaaggtgatctttacattgaggccaggatcatgaaagagccaggcaagcaaagagctgggggaagagcacagagatgagaggttaagggacctaacaaaaggccaggtggtcactggagagttttgagttgggaggggtaggggtggctaacctgatcatgttttgcctttaaaagatcgctctgttgggaagctgaggcgggcagattgcttgagcccaggagttcgagacaaggctaggcaacatggctcaaccctgtctctaccaaaaaaaaaaaaaaaattagcagggcatggtgatgtgtggaggaggctgaagtgggaggatcgattgaacccaggagattgaggctacagtgagccgagatggtgccattgcactccagcctaggcaacagagcaagaccgtgtctcaaaaaaaaaaaaaaaaacccaaacaaacaaaaaagatcactggctgtatggagaatacattgtagggaacaagaatggaaatatgatgaccagttagaggtggttgtgtgagttcaagaaagaaatgatggtgactggaactaaggaagacatggtggagacagagaaatgtcaagaattatgaaatatctgagattttatctacctacaagttaacaagttgggctgtcatagctcatggatgctggtagaagacacaagactcctgggtcagagatgaaggacagtttattactcacagcaatggcagtagccaggctatcagcctgtttgtgcatacttgagccctagttccacagggagacatgaaaagggccaaatgacactggcagatgcaagggatgcactatagaagaaccctgagcttagggaacccacatcttttatcgagggcagcaagcagcagtccatttactaagacagggaagactggagggatagcgggaggaggtgggctttgcacatggatttaggagttcttttgggggctaattaggtttgagatgcctgttaaacattcaagatgtcaagtaagtggcaggatccatgaattagatcccaagagagaggtcaggacttgccacgtatgaaagatggtactgttgagacagtttataaagtattttcattatactcagaactcccaagaatcttcattatacttagtgggaaaacacgagaattatttctcttaaaaacaagaacaaaaaagaatacttgcttactttagtacttcttgccctcaaatgtgggataaggaaaaaagaaaaaaagactcacttattgtaactgtgcagtaattacctagaaaatcaaaagaaatcaatctgaaaattactacagatagtaattgaagttagtaaaatgcaagatagaagataaagccacaaaaataagcccctgtgtattaataaagtacagtcattccttggtatctgtgggagattggttccaggacctccctcagataccagaatcctacataaaatgatgtagtattttctcagggtatgctgaagttataaaaataaataaataataaaattaaagtggtatagtatttgcatatagcctatgcacattctcccgtgtactttaaatcatctctcaattacttacaatatctagtaagtgtaaatgcgatgtaaatagttattagactgtattgtttggagaataatgacaagaaaaaaggttcagtacagatgcaacattcctttttcttttttagaatatttttaatctgcagttgattttatccatgagtgtggaatccatggctatggagggccaatgtacagctttaaaatgcacacactcagctgggcaccgtggctcacgcctgtaatcccagcactttgggaggccgaggtgggcggatcactttaggtcaggagtttgagactagcctggccaacatggtgaaaccccgtctctaccaaaaatacaaaaattagccaaatgtggtggcacatgactgtaataccagctacttgggaggctaaggcacaagaatcgcttgaacccagcaggcagaggttgcagtgagctgagatcgtgccactgcactccagcctgggcagtagagcgagaccccttctcaaaaataataaaataaaatgcacactctctcacctgagctgtttcatctcccctgaaccctttgcttctaacctcctttgaccatcagttttcaacttaggcttccctctgtccagaaagcccccctggtttccagggctgagttaggtgccctcctgtgtgagggagaccacactgcatggccagtttactcatcgatctcctgcactgaggaagtcagagagagagacagagagaaaatgttatggtggtaaccaaactttttaaagtatttatgaattcttaatggcagaaataaaagaagatgttgataaatggagacataaacccaattcttgattgatagggaacactgtaacttaaaattttaaatggccatttttctatatacagtgaatgcagtttcaattaagttattttatggaatggtgtaaactgacgctgagacttctgtgacggatgctacagggactgattcagtgggccatgttcagggtgccttttgattttcttccagggcgaacactggctaccatgtccacccaaggctgaggttatactgagcgttgtcattattctcttagcatgcccttggttatacactgaattaattaggacatgggcttgtatgagagaagcccaaatcacagtgacttaaaccagatgggagtttgttctcaccttaaaatctgagctgctacgatagctcattctgtcttcgcaacccatttcctaggatggtgctcagtctcctgcccccactggcctaccaccatgccttctttccagctggttggtagaggagagttgcgcttatcacttctgcctgcatcccattagccagaacatgatcacatggccacatctggctacaggaagactagaaatatagttttcattctgccacctgcccaggaaaaacaaaacaaaacgaactagtgtttctcaatggggttcagtattagcattttgggaaggacatttcttcattgtaagggaatgttccatgtaagacatttaccatccctatggcctagccactgaattccagtagcaccccctgggtttagtgccattcaaaaaatcctgcttttatttaaccatagctataggagacagagagaggggacactgggggcacaaaaggtctcttccagataatctatgtattacctggaagataatacacttggtccctgaacttcctaccagcagaaggaaatcatagcccatgtggccccaaatggtatttaatctagaaatcattttgacattggaatatggatgcgtcagatactccatgaattcataatgctttcaaaaatataatgtgcccacactgtgatggactgactggggcagagctgaaaatggttaacatctgtcatccagcttttcaattctccatccccgtctttcaggccaatgtaagttagtcacacaaagtcaagcttccctctcctttgccaaatgttttgactctcacctcccgctggtaggaggaataaataatgttttaaaaggactcctcctcctgcggcttttgtggaactatagggtaggtcactggtacgagaaaggagaaacagcgtgggtgcggtgactcacgcctgtaatcccagcactttgggaggcctaggaaggtggatcacttgaggtcaggagttcaagactagcctgaccaacatggtgaaaccccgtctctactaaaaatacaaaaattagccaggcatagtggcatacacctgtaatcccagctacttgggaggctgaggcatgagaatcgcttgaacctaggaggtggaggttgtagtgagccaagttcacgccattgcactccagcctgggcaacagaatgagactcagtctcaaaaaaaaaaaaaaaaaaaggagaaacaatggaaggtgtggggaacacagctgggtgaggcagagcggaggggtttaaagacatttgctctcattctgcctctggcttataatttagggcccatatttctcactaatcattgagaagacaatgactatagcagtaataattatcatttattgaatgtgatttaattggcaccatgccagattctttgcatggactgtcttatgtaatcttcacagcagaaaatatgcattattactctcacttttcagatgaggaaactgaggctgggcaagaggaagtcatttgccaaaagtatcgcaggtagtaaatggtcagtgcagacatccaatgtggctttgtgcgtctgattcagtgtctgtgctcataaccactttcttatccctgagctctgggccaagtcttaggaattagatatgtgattgagggaaactatatttatagggggtctactctgtgttctgtgcctgatatcaacacatattatctcactctgcaaggccagtgtcactgtcccccactaacagggaagaaaactagagatcagtgggcctgacataggagcttcctcttccgtcttctgctgcaaatgttccttgagtccctagaaatagagattctgattccaagggcctagcatggttctgatgggcatccagggtcaggagtcacaaccgtagataaagtactttctctctgcaggtactaccccagtggagatgcctttgcttcagggtcagatgacgctacggtatgtttctaagtttttgagagcttttcctagtcaatagagggatctgctaacttattttaagaaaataactatttttctggttacagaagtaacgagtattcaataaagaaaatttaggggaatattaaattaccttgatctccttacccaagaaaaatcatagttggatgaattcctttctgtctttttttctttttaacaaacaaaatgctttataatttggcattttcacttaacagaatgtgaacattttcccaggctggtaaatatttctctccattatattttcttagtgattgagtagtattccatgttatgaacgtgacattcgtcttcaatttttggacatttggcttttctcaaggtttttttttttttctgttaaaaacactactataagtgtttttgtacctctcatcatttccttagcattctcagacataacttgctgagccataaatagacccagttttaaggcttttgatactgattgccaaattattttcaagagaaaaaaatattttcttgttgccttcaaaatatcaaatatcttatgaagtaatggttttcattctaattttctgctaaacaaattacaaaagaatagattgagagttttgaaataatgaaaatttaaaacttctgtatatcaaagatacataacaaaatatatatggaaatatattgtaacaaaattataacaaaatataattataacaaatatatatggaaaaattcttgccacatacagtacagaccaagttgaaatcctgtagatacgaatggagttacataaacaataaaatgaacactccaattaaagaagagggtaaaatgcaggtcatttacaaagcagtgaatccacaatggcaagtaaacacctgaaaatattttcaaagtcacctataatcaaagaattgcatgttttaagttttaagtcatcggatgcccattttgccactaggattagcaaagaaatgcccagaggttgggttgatggggagcctggatcaaccctggggtcaggatagttggcaccaccctcctagagggcagatttgccatatgaatcaagagcttgaaaacatctctacttggccaggcacggtggttcatgcctgtaatcccagcactgtgggaggccaaggtgggtggatcacctgaggtcaggagttcaagaccagcctggccaatgtggtgaaaccccatctctactaaaaatacaaaaattagccaggcgtggtggcggtcacctgtaatcccagctactcaggaggcttaggcaggagaatcgtttgaaccctggggaggcagaggttgcagtgagccaagatagcgccattgcactccagcctgggtgacgagcgaaattccatttcaaaataaaatatacaataaaacatctctacttctgatctggtcatgctatttcctgataactcttctaaggattctatttcttaacctagtctaaggaaacctagtctaaggaaaccagaaacacatgtaaagatttttatataagaatagtcatcataatattatttataaaaaagaaaaattaaacacaaccaaaacaacagggtttggctaaatagattctgatatattcaataactatgtacataatgttttttgaagttctcttttaatgatatgagaaaggacgtataacctaatgttaataaaagcaataatgaaacatccaacccattcagatacacacataaaatacaaataagactgaaggaaacagctgagaattagtaaatacctctaggatttagggtgaccttcatttccttctgtttacatttttgaatatttccaaattttctacagtgaacatgtgtcctttatcagaaaaaaaagtggggtctcattttgtttttatacctgaagaaatttgctgtatttgccgtttctttactgactcatagagattaataggaatcaggactctttactgactcatagaaattaacaggagtcgggactaaaggatgaaataacagtagggaaaactaagaagtttttccttcatcttttaaactacgcaagtcactagcacctacctgtagctctgtggtcatcacgtcaccaaactgaagccagaagtaagtgcttctttatttatttgctccccagtgtcgcctctatgacctgcgggcagatagggaggttgccatctattccaaagaaagcatcatatttggagcatccagcgtggacttctccctcagtggtaagattttatttcagaaacttttcccaggactgtaagacaggaccagaatgaaactagcgctccatcatcgctcagttccttttcatcaactgagcttcctgtggaccagtatgcgaaatcatccatatttgcaccagttttcctcctctgagcttctgacctcccactttgtcctgccccaggcaacttcactccagggggaaatgaaggctgtgtacccacctaatgctgtccttcaaggcaatgaagtgtcagaaattcacttccacaatgctctcaggcattttctccccagcctttgcttctcttcatgccccaaagggaacttttctgtaaggtggaggtgaagcaagagtcccttcttggtgggatactgtggctcacgcctgtaatcccagcactttgggaggccgagacaggcgatcacttgaggtcaggagttcaaaaccagcctggccaacatggtgaaaccttgtctctaataaaaatacaaaaattggttgggcatggtggcgcatgcctgtaatcccagctactcaggaggctgaggcaggagaatcgcttgaacctggaaaatggagcttgcagtgagctgagatcgtgccactgcactccaccctgggcaacagagcgagactctgactcaaagggaaaaaaaaaatgagtcccttctcagtgccttgaagctcatggctcctttgtgggaagctgctggtgaaaaagcatagctccagaaggatcatgtcaaaaaaagaaagaaaaatagaaagttaaagcagaggtaacaggctggctacctggaccactccatttccccagacacatccctagactaactgcacgtgaagttcctgctactgcctggaacatcttttccctgccttctctgcatgacagactccgattcaaccctcaagagccaactcaaatgtcactttaactttctctctttaaacaagttttacaagttgttaactagcaaatgactaaaaataatttacttgtgtctgcagtgccctccttaatcccccttcctctctggtcccatagcactttacgtgtgtaaagcacttgcattatggctgttaccatgggatgctacagtgatctgttcctttcagccccacatcctccaacagggacagggactgtgctttctcccctttgaatccttgaggcaaagcacagtgcctaggactcagtgcgcctgaatcactgcttactgaatgagtgagtaacagtcatgtaatgagaaacaggaagcaaggaactggcttaacagctatcatctcaccctgcttcaaggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtaagagggatggttttctgttttcctgtgtgtgagaggagagaggactggtgacaggccttctgaagcagagggaaggctatcagagtaagctcaggtgggcctggtcagcctcgccgagctctcatttccactctgcccacagccacagagggaatgggttgcctggagaggtagcgagtgctgcatcagtgcaggtattctcgcacagattcgacaactgcgtatcagcctgtaggtgagggaatagttaggcttgatcatccagaaagttccttttgaccctaaaagtctgattcttgtgattctagcctttggcaaaccacagataaccagtctctcctcctatagtatagggttcttattacgattattgaccttgtgatgacaagggtcacaaatccaggaggctgtgaagcccctgaaattattacttttttcttccttttttttttttttttttttttggtttttctatagcttaatcttggaaatgaagcccctgaaattatatgccaaatttggggtgtatgccttttgtcctcgtggctttcattaaattctcaaagagagctccataaccttgttgagtgttggctcacccaaaatactaccaaaatagcctgtttaagctgggcatggtggcttatgcctgtaattgtagcactttgggaggccaagtcaggcggatcacttgaggtcaggagttccagaccagcctgggcaacatggtgaaaccctgtctctactaaaaatacaaaaatcagccaggcgtggtggcatgcacctgtagtcccggctactcgggaggctgaggctggagaatcgcttgaacccaggaggcagaggttgcagtgagccaagatcatcccactgcactccaggctgggcaacagagcaagactctgtctcaaaaaaaaaaaaaaaaagtagcccattcatagagcaaagctaaatttattgcttacctcagtgtggaacatcaagaattggtagaggtgtagtggcatctcagaagaggatgacaaaggcatgcatgaggtttttttggtctggtttaaggcaggtctttgttggggggcacttaattaggattggacaactttgtggcataatagttttaggattgctggatgcaggggtgggggagggtttcgaacaaaccctttaaaactaaatagtcatttgatgctctatattgtcctgagacatgggtgtgttttctaaagagggtaagttgagtagtctagtgttaggatagagaaaaggatttttgcaaaattcctgaaacaaataaaaaagttatctgtgagttcatcttcctgggtaagagtgtcctaagtgagtagtcatgttaatgtatatggtgagctgtatgggttcaaatggttttggttgtcaatctggaagagtagctaggcccgtaaggaggctgcagatgccccacagacaattaactaagggaggagaagatcaggtccaaagaagcacctttgcattgctaggagtacagtgttatccttctaaggcacatgagcaccctattttggatggagtgtgtatgtttgtgtgtgtgtgtgtgtacacacacatatatgtatgcccatgcatgtgtgtgaatagactaattttatctctttaagctcaagttttataagttgttaactacaaaggtctaaaaactatctgtttgtgtcttcacaggtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattat

SEQ ID NO: 36516 - DNA, 19139 bp, Homo sapiens
aaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtgactctcctctgaatcctccgcggtaaccgagccgggaagggtccgccggcggggaccgggcgtcccgcgtgtttcccgctgctggtgaccccaacgtgcccgcgtcgcggccttgccggccctactgggccctgcacaacgtttttaaaccgagggttttatctacatattattcatgtggtccgtttttattgagcttctgaggacctgggtttgggcctggatgcttgtgcgaaactgagtttttaaatcggaagtacctatcgaaactaccttgtaggtaaatgccggaattgaatataatttttactaagttgttttttcgagggtgaggctagcagcttgggtcagaatcaggacttcattttggagaagtcgtggacttctttgaaaaaatctaataaaaccggccgggcggtggctcacgcctgtaatcccagcactttgggaggccgaggcgggcggatcacgaggtcaggagtttgagaccagcctgaccaacatagtgaaacaccgtctttactaaaaataccaaaaaaaaaaaaaaaaaaaaaaatagccgggcgtggtggcgcgcgcctgtaatcccagctactcatgaggctgagacaggagaatcgcttgaacccgggaggtggaggttgcagtgggccgagatcgtgccactgcactccagcctgggcgacagagcgagactatcaaaaaaaaaaaaagaaagaaagaaaagaaaaaaagaaaatctaataaaacctatagagccataccgcaaaaatgcacctgctcataaatttggggtgaaattgggaatgtgggacgcccagttaagggctatccgggaggtgaggaaaggagatgcgggggccacgttgatctagtccctgggcctagatcattgtcaaagctttttatcttcaaggaaaggagagattagacatgaaaccttagaacaacacaagatttttaaagatcgggttaataattcggtgctgtctcccttccttcccctcctttagggctattcatctgacctttatttttttattttattttgagacggagtcttgctctctcagtcaggcggctcactgcgacctccgcctcccaggctcaagcgattcttatgcctcagtctcccgagtagctgggattacgggtgcccgccaccatgcccttgataatttttgtatttttagtagagacagggttttgccattttggccataccggtctcgaactcgtgacctaaggtgatactcccgcttccgtctttcaaagtgctgggattacaggcgtgagcgaccgcggcgggcctcatctaacctttaaaccttgtattgcgtgatggtttcacgtctgatcccacttcagggaagacagtccttttatttcctccacaattaatctagtgaaatatttcagaccgaaaattaggactcatgtctgatgaatgtgagtgtaaacaaaatttggcagacaaattgtatttagctcccagaaacaaatgaatgtttctggaattataagtatgaagaccaaaagcaatgtaaaaaaaaaaaaaaaaaaaaaaaaggaggaagtgagtttcttcagttgtatcatcccccagtgaatttggaactttagaagaagaagataccattaacttctacttgagggatctggtctagcaatctccactttttttttttttttttttagggtagtttagagttgcaggatgaactttcacaactgggcatgtgtgtcattctaacttttaatataattaatggcttatctctttattcagtcagaaacaagatgaattaccttaatcttggccccaactaggaagtgatgagtaaatgagattgctaaaatgattttaaaaaacaaaacaaaaccaatatataaagagaggagagaatctttttggctcattttgatatttatgaaatattggaaagctggtagaggaactacatgcattctgtacacatgtaaataccatgtataatctctctgtgaaaataggtgtgtaggtgtttgcccagagaaaagactgcgtcaaatagacttaagcatctgtacaaaaacagagggtagaatgtaatctttcatattcgagaaactttaattcaatgtccatttttcagcctttactacagtatagggcctggtgggggagcaaagaatgataaaaacccaagtttttatcctgaaggagtttatgatttatgatgcatgccttctgtcaacttttaactatcaagcagttgttcatttaataagctttgtcagctgaatttagtaatatatcactatttttctatattattttcttctcaatctcaaacaaaaatgcaattggccactatgtgatttgttgatattacaacctaactactgtatataaataaaaaatgaagagattgtcatttaaaatgagtttaaatgtagtgcttgttgaatctttctatattgtctagacatactaagatataatgaagatttttgagattttaaagaacagttgctgggcacagtagctcatgcctataattccagcactttgggaggctgaggcaggtggatctcttgagcccaggagtttgagaccaaccccgggcaatatggcaagaccttatctctacaaaaagtacaaaaattagccagacatggtggtttgcgcctgtggtcccagctactcaggaggctgaggtgggaggatcgattgagcttaggaggttgaggttacagtgagccaagatcatgccactgtactccaccctgggcaaaagagtgagaccctatctcaattaaaaagaaaatagaaagaaaagttgctagtaaaattattttgttttattgtttattttaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctgtaagtgaaagttttcaggaaaattactatccatttgcttatgttttttcacctacaatctttgttgtttctctttttttgtaacatcttttcacaatacaatattttctttaaaaaaagaaataatgcattatttttaaatcagagtagcaaaaagaagaaaaatcacccacaattctatcactcatagatagccactcttttgctgtgtattaccctagattttatttcacttaaaaatatatcatctttctataatagtagagtgccttcctaggggtaattacgctttttccactttgtgttgataacactatattgtgaatatctttctaagattagtcctgcttaagttcattctaacttacaagtcctttacaaagtatgatgtaatttagaacaacttgtgaacttggaggtcattttaccatctcatttatttatttatttatttattttgagacggagtcttgctctgttgcccaggctagagtgcagtggtacaatctcggctcgctgcagcctccgccttctgggctcaagccattcttctgcctcagcctcccaagtagctgggattacaggctcctgccaccaagccagctaattttttgtgtttttagtagagatagggttttaccatgttggccaggctggtcttgaactcttgacctcaagtgatctgcctgcctcagcctcccaaagtgctgggattataggcataagccaccatacccagccacatatcttatttctttctaaaacttttacttggattatcctattcaaactgatctcatttgatttcctacatttattatggagtagatacatgacatttcttgagaatatttatggtaaaatttatggctggtgtcaaaacaatgcttggctatctgtaatgttctctcaactcatggtgactaggatggaatttaaatgtaattggttagtcttttacttatcctaattaaatcagaaccagttgtagacatgttgagtcatataccatatacaaccgatttttttttaagtaaatgagcaaacaaaaccttcctttctgcatttgttgcaattctaaatttaatacagttttctctgtgataattctccttttattgacatagtctaagtagggagaaactttaatttagagccgaatctacccacggcattaccacagattagttgtatggatgtgggtctgtttcccctgttgcaaaatgtgagaattagataaaatgatctctgaagtcctataacccacttttaaaatattatgattctgtatcacgtaagtggtactttgttcttcccagttaaatgattattgatgtttgtgataattaacaaagattaaagttagtattttagattttaattcctaaaaaaagtatggtatctatgatagtatttatgtaattactatcataaccaatgttacatatcataccaatgataccatatgatatggttacatatcataaccaatgttatgtattaacattggttaatgggtcagtgtattggaaagccaaactcattaacttctctgacattataatactatttgtaaccatgaaatatagttcacacttctataaacttgtgctttaaagaacactcttcagaaaatataatggaaaagtatttactagaatttaaattttcagttgtggaaaaccattaacaataaattttaccaagcagctaagaagatcctttactctttttttttttttcttttttgcagggaaggaattgtaaaagatatggaggtttgggaatcatcagggcagtggatgttttctgtttattcaccagtgaaaaagaaacctaatatttcaggtaactgaaaaattgtgcatttttaaagtatgttctaaaactattattttctaaaaccaaaagaatgccaaataaagaaatcaactaccaacttagctacaactaggagagtttgggcattgtttaaagtattcgagtattctagccaaacttcataatttagagattaaggttggagaatatagtcttttaagacatatagttcttgggagaaaacatttaaataaagcccaggaagagactctacgttcttgattccctgtatgtacaactttggaacctcttagcttcctgttgtgaatagaagagtcatcctgcctgtcattaaggccttggctgcctggttctgttctttcttccctgtctttccttctaagaatagttgtgttgagacctgttctggagataatgtttaaatgtgaggaggcttagctgggctacagggatagcaacttttttttttttttttttttttttgagacggagtttcactcttgtcctccaggctggagtgcagtgacgcgatctcggctcactgtgacctctgcctcccaggttcaagtgattctcctgcctcagcctcccgagtagctgggattacagttgcccgctaccacacctggctaatttttgtatttttctagagacggggttttaccatgttggccagtctagtctagaactcctgacctcaggtgatccgcccgccacaggctcctaaagtgctgggattataggcgtgagccaccacacctggcctggaatagcatttgctttagaatattctctgtctctctctctctctctggcctggaatagcatttgctttagaatattctctctctctttttttattttttatttttatttttttttttgtccatagtccctaagccctttctgggctgaaacctagaccaccgggctttcccaagcccactctgggtgttcctgggcctccgtccttttgaggaaacagtgggtaccttgcaaatgggagctcttgcaatcaatatcgcagaaccttgggatctttcctctgtctcagttctagttgctcattttctgtgagcatttgcattacaacgcttcttatttattcacttgtccatttaacaaatatttactgaatttcttttgtgctaagtgctaggaatatagtgatgagcaagacagacaagatcccttccttatgaatcttacattcttgagggaggaaaacaataagtgatgcaaataaactaagataatttcagataatgatattttctataaagaaaccacaaagtattaagcccttaatcagcttaagtattagtacttgagtattaatccattccaaattgaacctaatgcctgttgccctaaagcagtggttcttaaaatgtggattcctgaatatagttgtcagataaaatatgggacatccggttaaatttaaatttcagataaacagtgtttttagtatgtgtacatgccatgtaatatttggggcacatttatactaaaaaaagtatttattgtatatctgaaattcaaatttaactgggcatcctgtatttttatttgctaagtctggcaactttatccctgaggcccttttaggagttgcctgagttcaaaaatattttctgataatactaagtgattaattgccatttttcactgtgttgacatttgcactgttggtgcagcagcattgaggagtagaactacttgtatcttagcaagaatcaaggcagaggcaataaattactagtagatgtcacaataaaaaaatgtttaatgccatttgaacttaagaacttcctttatgaagagataaaaattattaattttgttaacccttgaccctgagtacgcacctttttagtattctgtgtgacaaaatgggaagcacacaaaaagtgtgtctgccccatgcccaagtgtgatgaacaatcttgtgtaattgttcaagttggactgagctagccacttttttcaaagacaatatttatttgaaaggaatgacaactatggttatttagaagaaaacagttgatagtgtttattgccaatgaaaaaaattaaaactttcaagcaaaaattgaaattacggaaaactttgtcatcgtgagcatgatggcttctcagtacttaaaatctcttctgattaaatggatggcaacattcacaaatgtgagggccacacgcagcagctcatgcctgtcatcccagtgctttgggaggctgcggtgggagaatggcttgaagccaggggtttgagaccacctggacaatatagcaagaccttgtctctacaaaaaatacaaaaattagcctgagtatgatggcatatgccaagactcttagctactctggaggctgaggtggggggatcacttgagttcaagagttcaaagttatggtgagctctgatggtgccaccacactccagcctgggtgacagagcgagaccctgtctctttaaaaaatttttttggctgtgcacggtggctcacacctgtaatcccagcactttgggaggccgaggtgggtggatcatgaggtcaggagatggagaccatcctggctaacacgatgaaaccccatctctactaaaaaatacaaaaaattagccagacatggtggtatgcgcccgtagtcctagctacttgggaggctgaggcaggagaatggcatgaacctgggaggcggagcttgcagtgagccaagattgtgccactgcactccagcctgggtgacagagtgagactctgtctcaaaaaaaaaaaaaaaaatttttttgatgttgtataataacgtgccaatgtttagaagttctgcataactcagtgaactggcatttttcaaatgacttatatgtgatattacaaaattatgcatggctgaaagtccattctacatgcatgataaaccagtgaatgttaatataatgccacaaaaagttcattagtatggcttgagtctatgttatagttaacctttaaaaaactaccacttgttaagttttggtgtagtatcaaagaaaaatgtccacagttatttgaaaaagccatttaagtcttccttttccaatacgtgtctgtgtgaatgcccattttcttcatacacttcagtcagaacaacatattgcaacagaatgaatgcagaagcatatgtaagaatccagcagtcttctattaagccaaacattaagagatgtataaacataaagcaaggctattcatcttactaaattttcattttttgttttggaaaatagctttttcatttatgtagataagtaattgttttcttacttttaaatgaattaatactaagtttctcagttttcatttcaaatgtggtaattatcaatgtaagtaacccttgtaaacaaacattctttggggtccttaatgatttttaagaatgtaaaggagtactgagaccaaaagtttgagtacttctgtccttaggcatccattgtattaataaattaactttttccatgcagctataatagaatgatactacttttgtcaattttggcttttgttgccattgcttttggtgttttagacatgaagtccttgcccatacatatgtaacaaacctgcacattgtgcacatgtaccctaaaacttaaagtataataaaaaataaaaataaaaaattaaaaaaagaatgatactacttttgccccattttgcaagacttgagaaaattatcactcaaatcattttctgtgttctgtggtttggatgaggaattctggttgagcacagctggaaggaataggcaattaggggaacaatatttctttagatagagtggttatctattcctgggagacagtattggaaatgagtcctgaataaagagagggtatcagttatgggaagatttggggaaaacattcctggcagtaggactagctattgcaaaggccctgaggtaagaacaaggttggcagtgtttacagactagtggggcctgaattactggaggagagtaaacaagggaaagtaatatgacagtaaggccagagagatagccaggggccagatcatgttgggcctaattgcactgggcaggcagccatgaagaactttaagcaaaagagggacgtgatctgattagaaaaagctaactcagcatgctgtgtgaggggggagaaaggtctgttgggagccgtggcaaaagtagagatagggagacaagttagaagacattgctgcttgtgactagagttcatagcagtgaagacagaattggtcatatttgggttctctgttggagcttgaactggcaggatgctgattaactagatatagggaaagagaaatccaaggtgattcctagggttttttggcctgagaggtcagtaaagatggggaagacaagtcattagaaggaatccagggaaacatttagtctttcctttactctgaagcaggtgtccttggagttaataataactggattacaaggaattctttgtagaaaatatcttgaacattttttgcctttcttagtaagtttgcccaattataaaagttacagcttttgggccagatgtggtggctcatgcttgtaatcctagcactttgggaggctgaggcaggtggatcacttgagcccaagaatttgagaccaacctgggcaacttggcgaaaccctgtctctaccagggtgtggtggcacattcctatagtcccagctactcaggaggttgagatgggaggatcactggagcctaggaagtcaaggcggcagtgagccactgcactccagcctgggtgacaggaatgagactgtgtctcaaaaataaaaaacaagttacagcttttgctttagaaaacttggaaagtacagaaatatataaataaaataaaaataacctgatatcacagaggtaactactacattttagtatatttctttcgaaacatatacacacacaaacatatttcttgtttatgtatacaattgacccttgaacaacataaagtttagcggcactgatcctctgtgcagtcaaaaatccacgtataagctttgactccccaaaagcttaactactaataacgtactgtaagagaaaagaaaatgttaagaaaatcataacggatcaggcgcggtggctcacgcctgtaatctcggcactttgggaggctgaggcgggtggatcacaaggtcaggagttcgagaccaacctggccaatgtggtgaaaccccatctctactaaaaatacaaaaaaaattagccgggcttggtggtgcatgcctgtaatcccaactactgtggaggctgaggcaggagaattgcctgaacccaggaggccgaggttgcagtaagccgagatgatgccactgcactccagcctgggcaacagagcaagacttcatctcaaaaaaaaaaaaaaaaagaaaaagaaaatcataaggataagaaaatatattgaccattcacatagtggaagtggatcatcataaaagtcttcatccttattgtctttatgttgagtagcagagggataggtgggtgtggtcttgctgtctcaggagtggcagaggcggaagaaaatccctgtacaagtggcccctgtacaagtggaccctgtacagctgtgtgtacagttgacctttgaacagaactgcaagggtccacttgtacagggatgtataagttgttctatgtgtgtatatatgtatacctatgtgtccggaattggtgggttcttggtctcactgacttcaagaatgaagccacggaccctcgcggtgagtgttacagttcttaaagacatcgtgtccggagtttgttccttctgatgttcagatgtgttcggagtttattccttctggtggggtccgtggtctcgctggctcaggagtgaagctgtggaccttcgcggtgagtgttacggctcttaaggcggcccgtctggagttgtttgttcctcccagtgggttcgtggtctcgctggcttcaggagtgaggctgaagaccttcgcggtgagtgttacagctcataaaggcaatgtggacccaaagagtgagcaacagcaagatttattgcaaacagcaaaagaacgaagcttccacagtgtggaagaggagctgagcgggttgccactgctggctggggcagcctgcttttattctcttatctggccccacccacatcgtgctgattggttcattttacagagagccaagtggtctgttttgacagggtgctgattggtgcgtttacaatccctgagctagacacaaaggttctccaagtccccactagattagctagatacagagtgtggacacaaaggttctccaagtcccaaccagagtagctagatacagtgttgattggtgtatttacaaaccctgacctacacacagggtgctgattggtgtgtttacaaaccttgagctagacacagagtgctgattggtgtatttacaatcccctagctagacataaaggttctccaagtccccaccagactcaggagcccagctggcctcacccagtggattccacaccagggccacaggtggagctacccgccagtcccgcggtgtgtgcccacactcctcagcccttgggtggtcgatgggactgggtgccggtggagcagggggtggcgctcctcgtggaggctcaggctgctcaggagcgcacggaggtgagggggaggctcaggcatggcgggctgcaggtcccgagccctgccccgcagggaggcagctaagacccggcaagaaatccagcgcagcgccggtgggccggcactgctgaggacccagcacaccctccgcagccgctggcccgggtgctaagcttctcattgcccggcagggccagccggcagctctgagtgtggggcccaccaagcccacgcccactcggaactccagctggccagcaagggccctgggtagctctggttgccactcgcgcctctccctccacacctccctgcaagctgagggagccagctcaggccttggccagcccagaaaggggctcccacagtgcagcggtgggctgaaggtctcctcaagtgccaccaaagtgggagcccaggtagaggaggtacccagagcgagtgaggaatgtgagggctgccagcaagctgtcacctctcacctatacatatatacgtatacatatatatgattaggatcataatctagtttttctttgttttttgttttgttttgtttttttgagacagagtttcgctctttgttgcccaggctggagtgcagtggcgccatctcagctcactacagcctcggctggccttccgggttcaagcgattctccagtctcagtctcccgagtagctcggattataggcatatgccaccacgccgagctaattttggtatttttagtagaaacagggtttcgccgtgttggcccggctggtcttgaacttctggcctcaggtgatccaccggccttggtctcccaaagtgctgggactacaggcgtgagccaccgcgcccggctgtaatccagttttttttgtttttgcttttgtttttgtttttgttttgagacggagtctcgctttgttgcccaggctggagtgcagtggcgcagtcttggctcactgcaacctctgcctcccaagttcaagcaattctcctgcctcagcctcccgagtagctgggattacaggctcatgccaccacacccggctaattttttgtatttttagtagagagggggtttcaccatgttagccaggatggtctcaatttcctgacctcgtgatccatccgcctcagcctcccaaagtgctgcaactacaggcgtgagccaccgtgcccggccctagttttatattctaatttttgctttcagtttgtctctggtactaaaaatattagaatgaacacccttatacatagcaacctttgtttacatatataactatttcccaaggttaaatcctataaattgtattataagtcacaggatatgaatgtttttcaggcttgtgatgcttattaacaattatccctcccagaaaacttgtaccattttaattcccttaacggtaatttaggaaatgatacatttcaccacatttggaacaacagtaaataccagcttttaaaatttctgccagtctgataagtaaagcattttatctctattttaagttgcatttaactttatttcatttatttactatttgattttttttgtgtgtgaattgcctgttcattatctttgcccaaattcatttacttttctcatttatttgtaagagctatttgtacattagggcattagttcttctcttgtcatatatgttaaaattgcaattttcctagtgtaccatttgccttgtaattttgcttagtatagtttctggcagaatttttaaaataaaagtttgaatataaatgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctctagctttactatcaaaattattggcatttattttaaagattccgattgattcctcacttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttggtgagtatgggagagttttcttgagggaagtgtcttacctattgcttttttgcagaggatattttactttagatttggaaagcaaaacaaaaattttctatcaagaattatgatacacacattcccaaaatagcatcacttaagagtcagggtcttgaaatagttttctctgtgttccttggtcagaaaagcagaaatagttatgctttttaaaagctttttagggtaaagtttttaactttggtagtgctagttttgaaaatggcaaactattacataagtttaagtatttaaggttatctgtatgtaaaaagaaattactttgaacagttatatgaatgcacatttagaatgtaatgtatcgttttgcgactgaagaacacagtatgttccttgtcttaaacagaaatgcctttggaagatatatacccacctgtctccaaagatctatggtcccgactgtggcaagttcattatctttgtaaataaagttatgatgtttctacacccattaaaaagttcttaagaattttattttaaaataagatattcacatttataattttaatatttccaatttctcagatggtttctactctgtataaggatatgagagtaatgtctccctacacttagtgaatggttgacagtcccaacaccccacccctttcttaaatatgtgcttcctgaataactagactcttgtgcaagctaatttctttcatcttttagttcttgtaatgctatttgaatttagtgggacctcttggaagtagtctgtccttgtgtgagaggtggcccaccatcaccatggatgagagctgatggagaaaggataactgagtccaaagaactgtggaacttccctcagggctggaaggtccctgctccttgctaactgcccagggccccttccataggttagaatgtgggacaacccacccatagctgacttaacatgtatcaggagttcatgccttctttatactgaatggtaacccattgtatggatataatttgtttatcatctgcctgttaatgaatattacactgagggagagaaaccagaccaaaaaaaaaaaaatagtgtagaccatgtgattccatttgtatgaaactctggaaaagacaagtctcatttgtagtgatagaaagcagacagagtggttgccagggaccaggagcaagaatgcttttgagggctgggtgcagtggctcacgcctgtaatcccagcacttcgggaggctgaggcaggcggatcacaaggtcaggagtttaagaccagcctgaccaacatggtgaaacccggtctctactaaaaatacaaaaattagccaggcatggtggcacacgcctgtaatcctaactactcaggaggctgaggcaggagaatcacttgaacccaggagaggttgcagtctcaaaaacaaaagcattctttttttttttttttttttttttttgaggcagagtctcactctgtcacccaggctggagtgcagtggtgccatctcagctcactgcaagctccgcctcccgggttcacgccattctcctgcctcagtctcccgaatagctgggactacaggcacccaccaccacgcccagcttttttgtatttttagtagagacgggatttcaccatgttagccaggatggtctcgatcttctgacctcatgatccgcccgcctcagcctcccaaagtgctgggattacaggcgtgagccaccacaccggccaaagaatgcttttgaggcttccaaatgaaagaaatcgcttatgtttgctttggatgattaagaaagtcttcttgaaaggaaggagcaaatacaaagttccttgaaagtaggattaagatttcagtaagcagagatgaaagacatttctagagcacagaacagcaagaacataaagtactttcagggaatgggaaatgtttaatggatttttagtcataagcttttaattatataatagtggatctacttcgagtattagactgggtattctataaaggtcctttttacctaatatctagatttcttgataaatgcagatctacccttatagacactgaaaaaaatttaaaaatatttttctgattataatatctgctcattgtagaaatttagaaagtataaaaaagcataaataaaatttaaatcacctgtaatttatcagccagagataatcactgttaacttactaatgtacattttttatgcatattcatattactagttgtgattatactgtttatacagtattatgtcttatccttttcaacatcatattatgggcattttccatgttaagcatttaactttgccttttttaatgcacttttttcttctcttttctttttttgagtcagagtcttactttgtcatccaggctttcccaggctcaagtgatcctcccacctcaggctcccaaatagctgggaccactggctaattttttatagagatgggggtctcgctgtgttgctgaggctggtcccagactcataggctcaagcccttcaccctcctcagcctcccaaagtgctaggattacaggtgtgagccaccacacccagcctttaatgcacattttaaaaacttgaatttgtccataaagtgtatagaaaagatactggagcactattcatcaagcactttattatttgcacacttttttttttcagctctctgatgtaaaggatggagtaaatcaagcagcacctgcatttggatttggcagcagtcaagcagcaacatttatgtcgccaggtaagtgataaagtaatgcaggacttcactgatttagaaaaattagattttataggtttcaaattacaagcctgaatcgccattttaaattaccttcgtaaattctacaaccttccatcatagagcctcaaagcatttgactcattagacatttgtgaaagggaggccagattgggcatgttctttgaaagacacttaagctttagaagtacattttaggaatgagttttcaggagtttcgtagaagtacatagctatgatagcagcacctttgagaactttcttgtcactgtgtataacagcatagcattgtcctcaggtagcagctctggtgaggtaagtagaaaccaaagtgaaagtctattccctagtccctgtggtttctccttgggtgaaggtcgatcaaggtgaaaatgggattgttagcagaaaagacaggcagcaggctttagtgggtagttctagcctctcatttttactttcctcatctcgtccgtccagtaagcttctcaacactgaaacatgacataaataagaaaaaaagatagggggaggaaataattgtgacatttttctgaccgtaatagatttttgttgttttttttgttgttgttgttgtttgtaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgcc

SEQ ID NO: 36517 - DNA, 99044 bp, Homo sapiens
ctgtcctgggattgcctggagctccgcaccgcgagtttgccgcggcactttccgcgcggcggaagagcgcgcgccagcttcggcacacctgggagccggatcccagccctacgcctcgtcccctacaagctcctccaaggtaaggcgctcgctcacacccggtcctttccacgctcggcgggacagctgggtccccgcctcctctgcgaaccggctaggagctccgcgcctcgccttgggagtggggttgtagctgacggggacctcggaccggcggtggctagagcgcggagcaggcgatacgacgagccgacaggtggcgggtctagccctagtatctcgaccgccgccggcgcggaccttggtggggatggggcgggcgggccgacttgggggtggggtcagtcctctctcctcccttctaggggcggcgatcgtcggggtccgtactgtaggtgcgtgggagaaactttgcagggtggggacccggcggctgctggccggtagtgactggtgggcgcgctcgaggactccaaggggcgcagcccgggggcagacccttgggtcgggcggggatcttacgcttcccttacccgcccccttttgtctttcacctcagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggtgagccgggcgggggccgcagccggaccgggccggggcgggcagctgcctcccggtgtcttcctcctgggagctacccggggcgcagagtttacctcccctggctcgtacttgtcccttcaccgagttaggcaggcagggggtgatggagttttactctgaacaaatgcttcctgggaagttccccaaactcagagtaggacacgtgcttttcaggcttcctggccaggtctcagatccaggatccttttttaccgtggtagaaagacaacttatggctccaggacttgcccacctggacttggctgacttggccacctggacttggctgtttatgcttgatcagttagaaaaattgattaatggtgacgacattctctagggtctcacgtgcccatgtgaagttaccagtttatttctcctttcttaccaatgtttaataacatctgtaaagaaaatgttgccttagcaatatccaagacagctttatcttacagtgagctcaagatgagtatatccaaatgaatacgtgcactattttatatataaatcagctgtttataagttgtgctcctaaacacacagtgtttttctgagtgatacttaggacaatagggatgatttagtaacccacaattctgttcgctaagacgatctctttttgagtactgtgtctgaaaaacatgtggtagggtttttgtttgttttgggttgtttgcagtttggagcattttcgaaacgttacaggtagcagcatcttccattagagtgactggtaaaacatttttactaagtgtataatcacacctccctctaccagaaacaagacaaaacaatctcaaacaagttttgattactttgatagtagctcatggatttgaggaagtggttcaactaccttgtttcacctaaaatagttgcatctttttctcattgactgtttagctttcactttttcttctcctggctttctaattttactcaactttaattgtggtttaagtagaagcatttgcaataagttagggtgtatattaaatatacctaaatttttagtattatgatttccatacctgttaaatcatagtgtgtctttgtaggacgtatttatatgagcgtttcagagatttttatcagccagcaaaactgtcctctgcggtttgctacttgcacaaaagatctgttattcattaaattgctttagaaggaattcgtaagagtggtaatcaaatttctaggtgttttttttttttttttttttagttaaaaatatgaagattaaggggaaattgaagacaaggctttggaaaagctacattcctcaacttgatttttaaaagtagctgatgatccaaataaaagaatttgtcattttcaatcttttcctcattgttcatctgacagcggtcttattttgggaaatatcttggcagatgttaaacttcactttttttctggctgcatgtgctaaaattatttttcaagtactttttttttttttaaacaagggtaatgtttactgggggaagtaagtagagtgtatcttgtgagatcctaagaaacatcttttgttaatacccctgctttgagtaagagaacatagtgctgagaatgtagatgacttcccactacaatggagtctaatactctggaatgtttttcgtttgggtgttggcaactcctaaatttaatcttccctgaaaacaaacaaaccaagggtacctttttttttgtctgtagagtttgaacctttttattgaatagggaattgaggactgctttcttttagtggtaactatgtctctgtccgtttcaagctgcaggacccaacaaaacagtaatgcttcactacagtatctaattaacagacatacttcttgagcgcctcctcctcatattttcttatttttcaaaacaacttatgtatttcagattattttaatagtggtaaaatatatgatgcaaaactttaaagctgagccattttcatgtgtttatattgttgcttttttagaattgtgccatttctcctggtagtttcaacattgagaataccagttgctgtggagtttcttgtgtaatatttaatttagcacccctgttttaaaaagtcatacatattttgcaaatttttcgggtatgaaaataagtaaaaagatgaaaatgaccaatctctttatattcaaaagtagactttattttatctaatgtcgagtaagactcttattttcagacatgattcccaaccaagtctgtattagtagattaacatgtagttcatatgtagagatctggttttaatggtggataaacattaagttccttcaaggaagtacttatgaaacatctgtgtgatacatttattgtgactttcattacctcactttactagttatagagtgtatatataatactgttataaaggtatctgacagcagctaaagataccagaattgactagaagatagttataggcaaggaaccaggtcaaaaaccgaaactagctatttgggaggtaggaaactgggtggttactgcatgtgatggctgaagtcgatctatccagagcttctttaatgagataaaatttactaagagttttaagaaaaatatccttttttctaaatttttacattttctattttttggtagtaattcacctgaactgggtaatttggacgtggcatacttcttgccagtaatttttgtgtgtgtttatcagatcagtcaaatgtgtattacatacctgttaaagacactatccttaagcagtggagaaaataagaacacggcagtgtatattctcaaggagcaaggctataatctaggaagaaggataaggcataattacatgaaaaaatttaagtactgagttaacagtttaaaagccatcttaatgaagcatgtaactatttattggaaatagtgtgtgtttaaaagggggagatgattgggctgggagaagctattgaggatgagaatcttgacctgagtcttaaacttttcagtacttgtatatttttacatatgttctcacatatgtacatgtatacataattgtttgtatagtatattaagtaccgacatgcagtggttcttaacttgagcagcacattgatagcatgttaggatctttaaaaaaatgtttgctcatgctaattcaattccgtgccctctttgtcccttcaccccaccctgtaatattgaatgggtctgggatggatcccaggcattaatatttttataagttccccatttgattcaaatgtgagtcagtgataacaactgttggactgcagtctgggtatagaaatgaataggacataagccttgcccacgaggtgctctcaggtaatataaggaaatgtgaaaagtagagtagtaagtatagcttagtgcctgagcagggtacctaacccagggaggaggagtgatagttgaagaaagcttcctagacagttacatacttgtttccagggggtttgtgaagttactgccattgagtagggttgtgtgaatgggttaatggagatgggtgccatagaaaatgtaatctttgaataggtagaggtggcactgaagttttggtttaagtataaaagttaacatatacagtatttaaaacttctgttttaaaatagtggttggctaaagtggtttagctttagtggttggctaaagtgctttatgtactgaagttcacagcaatctcatgtggtagttacactgtttatcactatttccagaggagaaaatgaagacttagagcttaaatgattcaagatcacatagaaagtaactgatagagcaatattttaaacatttttgtgtattttgtgtgtatgtatatatctagggaaaggggagtttttaaaaattaacctacttttcattattcagcatatttccctagatttttacataactttttattaaagattatcttaagtaatttaaacatctgaatgaggaaaacagtaaaggtatggaattgaatagaatttcaggtcaaatttgtggactcagagattgcctctgaccctctaacctatagagtggcaaaattttgaacaccaggctctcggcaaaacgtaaatttatttttggctagtggtcagaaaatgtgaatctttgattttacctaagtgatatattgtttttctatcaagatggggtcatgacacctactccatagtttgaactcgtgttggtgaaagggaagataaaggagcatttaacatatagaaagcacttttaagtgaacacaggttaggtcataattatttagtatgtttattgaacattatatataggacaagttccacttagtaaactttataaatccaggtggattaagaaatgccttttgttattcccattatgctccagactgtctacctttctgtgtgatgagtcaggagagaaactaataatgactcagagttggagaaaatttgattcgtgaatggggtagatatagtgtaaacactgagactgtttagtgtaaaacctgggctattagcccagctttcctaaatgtttgagctcactggtaaagtaaattgaaattttaatattatcaggatttgtactgagttgtctgagctgggatgtcatttctcataaaaataataattacataattaaagtagatgacatttatggtgtgcttattaagtgccaggcactgttctaagcacttgacatacattagtgcatttaattctcaccacagccctatgggaaaatggggaagagaaggtatgttacttgcttcaggtcatacatgtagtgagaagtagattagagatagtttgcactcacagtcttgtgcgtaataaaccatcttactacacttcagtgtattacatactgtatacctagtttaagaaatacaaagaatattttagtgttaaattgttagtatatgactatggaatttaaaaatagccctatttatagaacatagatgaagtgagactttaatggaaaattttgagaacaaatgaatatataaacactggcattaaaattcttatttaaaatcattatcaagctagtggcctgtttatactattttctttgtttttttctttctttcttttttttttgaggtggagtcttgctctgttgcccaggctggagtacagtggcatgtggtgtgatctcagctcactgcagcctccacctcccgggttcaagcaattctcctgcgtcagtctcccaagtagctgggactgcaggtgtgcaccaccatgcctggctaatttttgtatttttagtagagatggtgtttcgccatgttggccaggctgctctcaaacttccagcctcaagtgatctacccgcctcagcctcccaaagtgcttggattacaggtgggagctaccgtaccaagcctatctatgctatttattatttctgcattttttttttagcacctatgatgtgtgccagaaaataattatgccatttaatagcaaggttgatataatgttttataagtataaaattattggcaaatattagggtttgacattttctctgtgctttttttccttttttaaaaattgagatataattcacatacaataaaatttacccttttaaagtgtacagttcagtggttttttagtattcacacggtgtgctcttaagtgcttttatattttcatctttatttttcattatgttcttagaacctctggtccctaaattttagctttcctttcagtaaagtgatatggtattcaaattatgagaagccattaacttaaaataatttaatatcagcctttcccactttacagagaaaatgaaattatggtaggatctcctcaattttaagtttcttaaaacttgggcacctactaccatttgtttgcagtggagtttagtataataggtatttattaggtttgtgcaaaagtaatcacagtttttgccattgaaagtaatggcaccagcctaatagttggattacttttgcaaaaacctaacaatttaactgagtgtaatactttcaccttaataaaacttttacatatctttcatggagatctgcaaagctctgtcatctaaacatttgggaacattgattcagagttaaaaaaaaaaaaaaaaggagtttccactgcttaccactttagttacagtactagaatcagtgtcctaaaagatgtttctggggggaccatctctaccagtatcacttttgccatttatttaaaatcagatttctggaatccaccccagtctgggttagggatgttatctgagagtctgcattttaacttgagtgattttggtacacactaaagtttgggaagaactaacttaaataccctgtactagtttactgatccgtcaaatgaaatgaatgctggttatctaacaggattgttacatgaattaaataaaatgatgtttgtgaaaatgttataaaaatgcccaaatcagaaattgtagttactgtataggttaatttcctatgaggttgttaaacattttcatttttttcttccaatttaaaactgtgcatattttaacagacaggttgagctacttggaaattcaaagtactttaaacatttatgtaatgtcacatacttagtgcaaaatgctctgtctgctttgcctcttttccagaatttagacaagtctagactacagaaacacctcaaatagttaatgcgtaattagaactttactttcactcatttttaatttttacatatctttaagtgaaagcatatacttgtgtttataaatgtatttgataattagcaactcaaacttttaaagcattgtgtttgccatcttatcaaactactatcaagtgcaaacatttttcccattgattacaaatcttacatgttagacctataggcatccttgactggcaattgattttgaacatatttggttaactgctgagtcaactttctgtttagatcttaggcaaatgtgttatagccatatacctacatgtatagaattgagcctcagccacctgttacattctccttaggctatgtaaaaatacacagggcaccatggctgaacgacattgtaggaatatttaaattctaaaagcagcaaaatcacacacttcaaaggtaaaaagagctccagcaagttcaaatcttagcatgtcagttgactagtaaaatgtttattctgtgatagtttttggagattttgtccagcaaaattttgtgggtcacagtgtatttttcaatgatagtctcatttattttaagtagttgaagaaatagggcagttgtattctgaaaattaatattttgttaggttttgctgaagtgaacagataggagagaatttatattgtggattacaattctgtggcagctgaaactttgttttcaggctcttcataataaattctgtggggccaggtgccatagctcacacctctaatgctaccactttgagaagctaaggtgggagaatcaattgagcccaggaggtcgagcctgcagtgagccgtgactgctcaactgcactacagcctgggtgacaaagtgagaccctggctcagaaaaactcaaacaaaacaaaactctagggggactaagagaataggataaataaacataataatatacagtttgaaatacagaactgaaacagatgaaattaacttaaaaagacatctttcagactaagcttatctatggtcatgtaagcaaactacttaatattttagaatttgcaggttacataaagtatcaattgattttctattattttggagttttttccagaatatttttagtagtatttaaaaagaatgtaaatctcagaacagagttaacattcagaagatggtgcttgaggaataggaataaaaagtacgattgtattagctgaaataatcaaagaagttacttttaggtttcaaattcttgaaagacttctccatatcctataatgtaagcaaaagttgatgcaaatcaaatttatgtaatcctaatttttttctgctagtagaagtaatgtgttaaaaaaaaggcagtgtgttcactgtagttctctcatggaaataaatccaaggaaaggtagaaaaacctgttatcttatacatattaatatttgtgtttctattcttatttttttgaatctacttgagaaatggaaccacactattgatttgtgtgtatacttaaccactcatcatgagtatttttatgatgttattctataacttcaaaaataggggtggatgtgtatgtatcttttgttgtatgttttttagagacagggatcttgcttgttccccaggctgcagtactatggtgtgatgactcagcctcaaactcctgggctcaagtgatcctcttgcctcagcctaccaagcagctgagagtacaggcatgagccaccatgtccagttggatgcatgtgttttgtgctgtttgatattaaaatacttaaccattacttcattgggaaaggaccttactgcttatctgccttattatgtggctttttgattagcccataaatagtcttagataaatagccctttcctttcctttcctcccctcccctcccctccccacccctcccctcccctcccttcttctccttttttctgagacaggatctctgtcacccaggctcagtgcagtggcacgatcatggctcactgcagactcaacctcctgagttcaagagatcctcccacgtgagcctcctgagtagctgggactgcaggcttgcaccaccacattgggctaattttttaatttgtttgtagagatggggtctcagtatgttgctggtcttgaactcctacacgcaaatgcttctctcaccttggcctctcaaagtgttgttgggattacaggtgtgagccactccacctggtctatttttttcttttcatatattgtgtttcctgaaacattgctcaggaaaagtgtttgtgccattgaaagagtctcataggttcagataattgtgaaggatgaccagaggttttttctttttttaaacctctataacctttgatttcactgggaagttggtggttggagctggagtaattataaatgtatgtatgctgtagctgaaataagttcctgaaactcatcatggtatgcaaaattgtgcagtaaaaactgtagggcatatgtgaaaatggagtttggggcataacactcaaaaactttgtcaatggcatttaaaaagatagaaacctaataaaaactagcagtttcacacatgttaaatgcttaataagtacataaatactacaacaaatatgacactttactttgaaaaatacctaaactttttgaaaagtgttagaaggatcccagcttgtgaattactgtaaaatggtaggaggaaggttatctgaaattggagtgagagtgttacaccagatgtggatgggtgtagctcataacgtatgcagtgaactgacgtaactggcagatgtttgaggtgtgtatgcatatatttctacgtgactgggttgcagttatctgtgcctgctgagcatttcttgcatttgaacataagcaaacacaaaattagtgttattctcaacttgttccctaacatgtgttcatatcagtggcattgggacaaatccatgtttttctaaacaaatgttatagtgcgtatatgtctacccatgcatagatatctgtatccccatcaatctgtctaaaatatgtaaaacgttgtaaaaacatagaaaacaatggcttgggaagatcaatccaagtaatgacatagaggaaaggtataggaagcagagaaatgggagtactcatataagagtatactaataatgatcgctagggcaatagtggtagaaaaggaaagaaagaatagatttcagagatatttcattggcattaaaaattacataactggatgttttgagctggaaaagtgtttagagatcatctagcccattacaaaaaacaaaacattaatgtagtctttccagaaagcttttacctcaaaacttaagttgcatttcaacctcaacctttttcctctagctgagtctagcatatcccccactgctcctggccccaccaggctaatactactgccgtatcagggattttattttattacctcttacttaaatactcagcctctacctcctggttcatcttgtcatgcagaaatgttcccttaattttgctttaccttcagcttactgttttttctccataattggtcagtttcttaaaggcaacattttcacctgctgactgttcatttcttactacagtactgaaattcatctctctaaggttgcctgtgaccttttttttgtaccagtgtcaccaaacttgtgacctcttaattgccgaatgtgacagcttctttcattccatttgtcctctctgtagcatttgccctgtcactcctctcatatgctgcagcattttttatagattcttttataagaatctatatgtaaatgtttcttcagaaacatatgaatgcctgttgtgtgccccaggctcagtgctgtgtgatagaaaatattcaccagtctttaaggaacttctaatctttcagggaaagagataaataattagaggttagtataataacaactatgatggagaaaagagcaaagtactgaactagcacagaaaagggggccatgggccgggcacagtggctttcacctgttatctcagcagattgggagacttaggcaggaggattgcttgagcccaggaattttaggctgccgttagctatgataatgccactgcacttcagcctgggtgacagagtgagaccttgtctctaaccaccatcctgtgcctcccacccccgccaaaaaaaaaaaaaaaataccctaaagggagccattaattaaggaagtcaataaaggctttacataacatgaggtggtattatgctttaggtctcagttggtaagaaagattctccaagtgaagaggggaacagggtaacatttcaggtagagcaaatagcacgtgcaaaggcacagaactgggaagtaatagaaataataactttatattgcatgcctgctgtatgtccagaactgcacagaaggctttccatgggttacatctaatcttcacattaactcatgaggtaggtttttatttttatcattttacaagatgaggaagttgagcctcaaagaagttatgacttgcccaaaggccatcctggcagaacttggctttgactccagatctgtttgggtgccagtgcccacacattggttatcattgttggaaataagcaggatatgttctaacagaggaaatggtgatgttcagaaaattcatgatggggagtgaatggagaacagttaaagaggattgatatggaccaattgtgttggattttaatgccatgccaaagaattcagactttattctgctgttcagtattgttgactgggtacttccttcctctgtccatatctgtttatgcaacaactctcacaggttttggaaagaaaacagttttgtctgcctaatttgaaatcattaaaaggattgtcttgttcggaggcagatattcaagagtagtaaacaacacaaaatactgtgaaaataacatatagtagaataaatcaaaatttccatatgcattaaaaagaaactagaggataggatctaaacaaagttgtaccaagtgatttcttttgatgacaaaaataattatataatgaataaatttgagtgtttgggggtagagggcagatggagtggaggtggggaactccagtgatactaaattgctagagtttgattctagtgtaatcatggagaagtttatagcttaacgttatccctgagtttgtactttgccctgcactttaatataaaaccagtttattgcattctgattctctagttcattctgtaatacagatggtaggaatacaggtgcttaaggatgggaattgcctttgaatttttctccatgtattacttgtttaacttctacaagtgttttctccctccatacttccctccttcctggtagtatcttcgaggaactcaagggcatctccaaaccatgttttaggaatagtattcagaaaatttgaaataaaatagcaaatctaggattgtgcaaaaatcagctatagaatattacttataaatttaacaaattttcttccatttttatttttatacattgggattatattctatgtacattcttataacctgcctttaaacttgacattgtcttattatttcattttaagctttttttaaaaggagaaatgttattacttttttttgttgtttcataaacacttttgtttcataatcattttcattggacagtgattctgactatccagtgatactagtactttatatttttggaatacaattatttgaagccacccacaaaataaatgtatttatccagaaatttaatcattctacagatattgttacaacatttttgttatcactatctttacaaacatcacagatgtgttattcttaatgtctacagaatattctctaatttggatgttccggtatagctagcatacatttactaccttgttagtacatgttagacactgcactaggccttttgaacgcttaagttaatacagctgttctgttaccagcactgccaggatttggacaactctgattttgtccttgagtactttataatctaactcagaaaaacaagattatataggacaattcttgaacattaaaaaatgagtataataaaatgttaaatgttaggtcatactcttagtacagatatttgagagattcctggaggattgaatggtccaggtaattttgtgaagggaatgtgagatttgaactgaatcttgaaggactgataagaaatgcacaggtgaagaggagagttctatttcaggctgtgaaagcagagtgggcagtagtacaaagatgagaattagtaacctgattggggtagagggcttatgttaggaaatagtaagtgaaactgagggagcagaatagtgaaggatcttaaaaacaagcccgaaggtttttggtttgatgtatccggctacaggagaacttgagcaggatatgttcatattgtgagagcaaaattttaataagatcaactatcaggctgtagtacacagagcagactagaagaaagagagaatagagataaggagattagttgttgccatactctagttgggaagatactgtgtgtgaaattatagaacactatagcagagaatacagtttattaatgttttcagttttatgactatttaattgactgttagtgtcttcagttggagtacataggggagcttattattatcttgagtcacatgataatttgaaagattgattaaatcagaaattgcttatactacaagctggctcttagaatattttattaattatgggtgaagaaaggtatttgtatttctgaataagcaggccatattaatgtgagattacacttaagtgctttttgagcctggtactattctaagtcctttacatgtattaactcattaaatttttagaacagctctagatgggtcactgctattattattattatttctattttacaggtgaggaaagcaaagcattgagaagttcagatttctgatttgagaaattagttgctaactttgcacttgcctccattcttgattttttttttttcctctgtttccaacttcataatgcgatcagggtcacttctttctcctgtgcttccagcttcacaatggggtcagtgtcaccttttaaatactagcctgagcaaaacaaatatattaagcttgctgttattattttttttctttccaacttttattttagattcagggggtacatttgcagatttgctgcatgggtaaatttcatgtcgtgggggtttggtgtacagataattttgttacccaggtaatcagcatagtacccataatatccttacccttctcccaccctccactgttaagtaggcccagtgactattgtttccttctttgcgtccatgtgtacttaatatttagctccgtcttataactgaaaacatgcagtatttggttttctgttcctgcattaatgtgcttaggataatggcctctagctccatctatattgctgcaaaggacatgaccttgttcttttttatggctgtgtaggattccatggtgtttatgtaccacattttctttatccaatcaactgttgatggggatctgggttgattacttatctttgctattgtgaatagtgctgcgatgaatatatgcatgcttgtgtcttcatggtagaatgatttattttatttttatttttatatttgagagacagagtcttgctttgtcacccaggttggggtgcagtggcgtgatcctagcttactgcaacctccaccttccaggctcaagtgatcctccccacctcagcctcccgagtagctgcgaacacaagtgcggcaccacgcccagctaaaattttttgtatttttagtagagacagggttttgccatgttgcccaggctggtcttgaactcctgagcccaagcgatccacccgccttggcctccaaagtgctgtgattacaggcatgagccaccgtgcctggccctgtggtagaatgatttctagtcctttgggtatatacccagtaaaaggattgctgggtctggatggtagttctgttttaagttcattgagaaatctccaaactgctttccacagtggctgaactaatttaaattctcaccagcagtgtttgggtgttcccttttctctgcaacctcaccaacatctgtggatttttggctttttaatagtagccattctgactggtgtgagatggtatcttattgtggttttaatttacatttctcaaatgattagtcatattgagcatttttttcatatgcttgttgctacgtgtatgtcatgttttgagaagtgtctgttcatgtcctttgcccgctttttaatgcggtcattttttttttggcttattgatttgcttaaggtccctgtagattctggacattagacttttgtcagatgcataatttgcaaatattttctcccattctgtagattgtctttttactctgttgatagtttattttgctgtgcagaagctctttagtttgattaggtcccacttgtcaatttttgtttttgtttgaattgcttttggagtcttcatcatgaaatctttgccaaggctgatgttcagatgatatttcctaggttttcttctagggttttcatagttgcaggttttacatttaagcctttagtccatttgagttgatttttttttttttatctggtgaaaagaaggggtccaatttcagtcttctgcatatggctagccagttatctcagcactgtttattgaataaggagtcctttctcctttgcttgtttgttggctttgtcaaagatcagatggttgtaggtgtgcagctttatttttggggttctctgacctgctccattggtccatgtgtctgtttttataccaataccatgctcttttagttactgtagccttgtcgtatagtgaagtcgggtattgtgatgcctccagctttgttctttttgcttaggattgtattggctatttgggctctttttttgtttccagatgaattttagaatttttttttctaattctgcaaataatgatattgatagcttgttaggagtagcattaaatctgtaaattgctttgggtagggtggccatcttaacaatactgattcttcctatccatgagcatgggatgtttttccattactttgtgtcatctctgatttctttcagcagtgttttgtaattctcattgtagaaatctttcacctccctggttagcttattcctaggtgttttattctttttgtggttgttgtgaatgggattacattctaagtagaagaatttaaccttgtgaagtgcttatatgaggaataaaaaatgctaccataaagtatattacctatttttagctcttattttaagttctcacaaatctcagacctctgacaagggagtgctgtttggctagtattgggttactgaatttgaaagaggagctcaggctcagctctttgaggagaggcctccaactggctggtaacggagtcactgaggggcacaataaggctggtttcagctgttgctacttgaatgagtgctgctctagtgactaagcaaggctcaggtgaaactgacagaacaggaagcaaacttgaagaacaaatcacttcttccttctccagacttgcaatttccttttctctctttgtattggtagacactagaaagaaatatgattaatttagggccgggcgcggtggctcatgcctgtaatcccagcactttgggaggctgaggcgggcagatcacgaggtcaggagatcaagaccatcctggctaacacggtgaaaccccgtctctactaaaaatacaaaaaattagccaggtgtggtggcaggtgcctgtagtcccagctactcgggaggctgagggaggagaatagcgtgaacctgggaggcggagcttgcagtgagccaagatcacaccactgcactccagcctgggagacagagcaagactccgtctcaaaaaaagaaatatgattaatttgactcacttaataatggttgtggtaattgagaaatttgacatctaacttgatatttgataatattaagtaatcatttttcattattttcgttgtggtagtggtttagtgtgtgctgtagaagaattgttttagagatatatattggtatatttagagaagaaatgcctgggatttgcttccaaataatataggacagatagtggtgggaaagtaatagaaatataaatgaaatttgtacttgttgaaattgcagtaatgaacaaattaggattattttattttctctactgctgtacatgtttgaaatacagaaaaaaattagaatcttttttttttttttggtgatacattcaagttaataaaactgattctcgttgaggggtatggatgtgatctaatacacacaataaacttgatgataagtaccttggagaggataaaacagggagataggctatagagagtagaggctgcaaagtggtggtagcactttagggctggcaaggaaagcctctatatggagcaaggtatttagttgagatccaaactttggaaggagccagttaggtaaaaatcaggggaaggagctggggtaaaaatgttctaggtaggagaatcggaagagattgtggggagaaagaaaacaaaacaaaagttctaggtggagggaacagacattacagaggttttgaggcaggaaacttcaagtattcaacttaaagcaaaagttgggtaggtgagaagagataaagaccaggtcatggtagagtttggagtttaagtgcagttgggagctgcttgttggttgaagcagaggaagtacttgatctaatttttgtttcagaaagatcagtttaggttgtaggtaaagaatgggctctgtgtacgggaaggagagggcagaccactacagcaatacaggagagagtgaccaggtgggaggtaggggccatggagagacgggattgcgtatggaatatgttttagaggtagagctgacagcactttctgtgagaagcagagcaatcaaaatgataattaggttttcctttagagcaattgggtggatgctgatgccattaactaacaatacttttcactgctattcgtgcagtaaaatgatgtcatgcagaagtatagctttttaatatttttatttttagagatagggtcttgctatgttgcccacgctggctttgagctcctgggctcaagtgatcctcttgcctcagcctcccaagtaactaggactacaggtgcacaactgtgcctggctgtgtcctttttgtagaaattatgattgagcctctttataaataatcttaacattttgagtatatgctaggcattgttctaagttcattacatgtataagcttatttaattatcataaaaagttaaatgaactatttgtctttatatccctcgtatcgaggaaactaaacaattaacatggtaaacacatcaacaagctaaagaagaaaaatctcatattaatagatggagaaaaagtatttgacaagatccaatacccattcacagtaaaacttcttggtaaactaggaatagatgggaatggcctcagtttgatgaatatctacaaaaacctatagccatatatttgaatttagagaagctacttctacgctaactacacataagggctatgtttctagtacagaatattgattaaaacctttcctgttttgattaaatctagccacatgattctcctagtgaagggatttaatcttgaaattggtggaatattttagatggtaaattgattagagaaaagagatttcaattatgttgtctagtactttccattttgttgaattaaagtttaaaacaccaccaaacaactttaggctgtagtggaatttaaaattagtatttgaatgtaatgttttctttcctttttttttttttttttttttaagtgctaaggtcttgctttttgcccaggctagactcaaactcctaggcttaagcaattctcctgcctcagcctccagcgtagctgggactagaggttcgtgctactgtgcctggctaatatttttcctttttaagctaggttttccttgacagtctattttagtatccttaatacttagctcagtgcttgacatgtaggattaagaaggtggtctgtcaactagggaaataatgaaaaaaaaaaacccctaaaaaaaaagtggcaaacatattctgatatggaaattatttcatttataaattgtgttttcttctaaggttttgctttaaaatcacaaaatcttgaagtacacttaaaatttgaagttcagcttatgatagccttttttttattgtgaactgaagttttaatatttgatactagagagtatctattgataaattcgtgtagttataagaaaggttcagttacagtgattgctattaccttgatattttgtaaattactccctttgtaacatttgctgtctcaggaattattttttctaatgtcagatggacttttcagaatgaattgaatgagatatttttggcattttgaaacctaatgatttttctatgaagaatttttattcttattcattgcattttttttttccccaagaaaaaatgatgtataatagtgacacataagatagacattctcctggtaaagtatattgctctttggattttattttgatttcagtaacagatttgataatttggttttttaagctttcattacctaattctgtaatctttgaggatacaattcaaccaaccaaccagccttttctataatttagtaactttacttgcatttttctcttggactttgcttatgtactgccaattagttgcttaaaactttttgtcattgttaaaactgtttacatggctttttaaaatgggggaaaaacaatagaaacatgctgtggtgcaacgaatgaatacagtgtgattaacaacttaattttttttcctgtttcaaacatccacctatttttagcattttgtatacccataggttaaaaatatttacatttttcttagaaaagtaacctgtttaagaacaaaaaaggccaagcgtggtggctcacatctgtaattccagtactttgggaggtggaggagggtggattgcttgagctcaggagtttgagaccagcctgggcaacatggcaaaaccccatctctactgaaaatacaaaaattagcccagtatagtggtgcacacctatagtatgtttgaaccgggaggtggaggttgcagtaagccaagattgtgccactgtactccagcctgggtgacagaacaagagactgtcttaaaaaaacaaacccaacaaacaaaaaaaaagaatgaataactgtttattcattatataaataacttatttaacagtttcagtatattttgaaatctttttccatgtatcatttgatttttttctttttttaaagaacacttgagaattactcaactaagtttagattatctagatgtttgttagagttgctttcgttggaggacttgaaaatgaagtatgtataatttaagatggttattagaagaggagtttttttaaatatatttcttagttatttaaggtctgcagatacgaaaatcatatgtcccaaaccaataatcaagatataagataatatggcaagttgaaaagatagaacagtgtatcttgaaatttgcatagtcctgagaatagacatggccctactctgtaatatggcttattccctccatgcagggaaagttctgaggcctctctaattcttaaatctattttgcaaattactttttaagttctattaacatcattgtacaagaaaccctcaatttaatattgttggtcttatatccctaatctttacataatctgcactgtgtggggaatcttctgcatagctcatgccagtaacttttagggctattttttaaatatcaccaagactgaagtcattcaagccaaaatgtgaagactaaaatctttgatgtatctgaacagaaaaagataagtgaaattatttaaaaatgtacttcattcttcctttccctagctttgtttgttttgaactgttttcttcataacagcacacagttggaagtgcatgtgtgtaaatatgtttgtatttgattgggatgagagtatttccttccaataggaataccccaacttgttgtctggattcctctccttatatttgtattctctatacaggggtccccagctcctgggccgtagacccgtactggtccatgacttgttaggaaccaggccacacagcaggaggtgagcagtgggcaagcgagcaaagcttcacctgtatttacagccattccccatcgcttgcattactgcctgggctctgcctcctgacagatgagcggcacccttagattctcataggaacacgaaccctcttttgaactgcgcatgtgagggatgtaggttgtgcactccttatgagaatctaaccaatgtctgatgatctgaggtggaacagtttcatccagaaaccatcctccccattatccccctggtccatggaaaaattgtgtcccatgaaaccagtccctggtgccaaaaaggctgggaaccactggtctataattttccttacttaaccagttgtttttgtttctaatattttagaggtaaagagttcagaagtaagataaaagaagaccaaagacaaactacttcagggctatttcgtgaagcagaaacagcacttcatcaggtggcttttgcgggaggaagcactgttaatgcccttaggcgtaagggtaaatgattcaacttacttaaggaaatacattttcttctaacttgaaacattaaaaacaaaaaatatctacaaacttttactatagaaagatcaaatgtggccagcactttgggaggctgaggtgggcagatcacctgaggtcgggggttctagaccagcctgaccaacatggagaaaccctgtctctactaaaaatacaaaattagccaggcgtggtggcacatgcctgtaatcccaggtactcaagaggctgaggcaagagaatcacttgaacccgggggacagaggttgtggtgagccgagatcgtgcctttgcactccagcctgggcaacaagagcaaaactccgtctcaaaaaaaaaaaaaacaaggaaaaatcaaatgaacaaaaggaaataagatagtattatcaaccctatgtgtgaacatgttaactagcttcagttatttttaatttatggctcatcttactttattgatttcctccaatttttattgttttgaggcaatactggatatcatttcatttgtagatagtatgaatttattaaagataaggactcttatttttaaaagattactccattccactattacatgtaaataataattcattaatatcaaatgtccaatcagtgcccaaaaattttcatgggtatctcatatatgtcttttatattttgtccaaataagatctatacattatagttgcttgcaatgtctcttaacttgtaatctttacattcttcctgtattattttttcacagtttatctgttgaataaagcttgttgtttctcacagtctagattttgctgaatgcatcccccgtggtcttgtttaatgtaatcttgtaaactatttcctataatttggtaaatttagatttaaactagaggtttgatcagatccattcattattattattattattttgacaaggatacattatatgtggtattttgtacttccatccgaaggagtaaaagtctagtcagttctttttctatgtcagcaatcactggtaaattgcctagatcagctgtcaactcaaaatattaatatctgagacaggtgtcagtcaatttagaaaatttattttgccaaggttaaggatgcacctgtgacacagcctctggaggtcctgacaacatgtgcccaaggtggtcggggcacagtttggttttgtacatctagggagacatatgagacatcatgtaagatgtacttggttccatccagaaaggcaggacaacttgaagaggggaaggggcttctaggtcagaggcaggtttgccctaagcagttcccagcttcacttttcccttcagcttagtgattttggggtcccaagatttattttctttcacaccaaacttttcagccttaagatccctttacattcttaaaaattattgagtatcctaaagggtttttgtttatgtgtaaatatcactgtatgtatgagcatttacttttttagaaattaaaaccaagaaattttagaaatgcctgttattaattggaaaaaaagcccactgcatgtttatataaataacatttttgtgagaactattttccaaacaaaaatttagaaaattggtccactgtttaacatttttgtaaatctctttattgttcagctgaaaagaagacatcctgtttctcctatctgcttcatcctttagtttgttgtaatattacatatcatgtaaccgttggaaactttgtgtacactcatgggagaatgaggagagaaaaggcaagtaagattttagcattctaaaaatagtttgaccttgcggatcctctgaaatggtcttggggactcacaggggtgcttggactatgatctattttattattggttgcaaaatggtggtattctaattcattcctttgtaatttattacctggaatattttatatagagaaatttcctttcatcagctgttttagttaccttgagatacaatttgtacaaataagatagcctagatgcttgattcttttcctttaaggagacagaagctttattgcattcattttactatgtgagaaagagatgagaagactacttttaagccccctttgtactaattgaaaccgcctccacttaacaagtgaaggaaggactccactaatacagttggcttcttaaattattaagatgcagtttgtatcttagaggttgcttattttagtactatatcaactaacactatataatctctttaagaaacttgcttgaggagtctaaaaaggattggaagctttcaagttatctgatgatactttcacctatttccttgtgaaaatgcaaagttaacaagataatgtctgcgattagcttaaaatgcttatttattgtgagatatattactattaactccatggaagagaaaaatcaggctctgttacgggatattgagttttgctgcagtttgattttataaaactcaactaatttgcttccagaattgcttcaaaaacttgagcgctcttgaggcaagacagggagttgtaagctgtcataaatgatacaacccagagactaagacttggaatggaatgaagtctggagagaggagatgtatatcagagtagtgtaagtaataggttaattaggcataatgaaatttcagttcttgttcttaaacacaaatgaaaggggaagttcatcttaattccttacttgtatatacttgagatgaaatgtgaagtcagttttcctctatgtaacaatttttattttaattgacttacggaatttttatgatacaatagaaatacgttgagacaagtttattgagccaactatctatacatcttaaaatatttggcagtttaaatagtcatttaatgtgggttagatgtgggaaggatgtgagttgaaggatggaaggaagctggaccaaatagcataatctgtcagcaaaataaatcttttctagttagacttaatctcttgttgtttttggacctgatgaaaattgttttagagattggaacttaatagaatagttatggtttgaagatatctgttttagttatgtatttgtagactataagaaaagtaaatggaactaatttttgtctctataaaattttccttaaaaatcagatttttttgggaatcttctgagtagtaccatcattctatggaaacatatctcagaaattaaatcttcattgttataatctgttttttcatattattggaggtacatagtaaacctcacagttgaaccttaaaatataactattgttgacttttggaaaatggtttagtgaattgctgctcctccttccaagttggaaattgaagagatgttgtgtagttgtaaatgctgaatgcagtgactgaatgttcactacatttttggtttacagcaatagtagatgtattaactatacttgcacaataatcactattttatttttgttcaagtataggccttggaactttaaaaaaaaaaaatagccagacatgatgacgcatatccgtagtcccgagtacttgggaggctgaggcaggaggatcacttgagtccaggagttcaaggctggcctggacaacatagcaagaccactctctctctctcctcccccccccgccaaagagtctactttgtccttaaaataatttgatagcacatttaggaccttatttttaatactaccttttgaaacattgactttctaaaaaacaatgtgtggccccaaacaagataatgacatgggtttaaaaacaaacaaaaatgccctttcagggcatgttacagtaaatataggtttagtataaaaacttggtattaaagtttttggtagttaatgatctggaagcatggcatgatcctaaagttctaaaaattagagaagactctaagtaagatagtaaagaaatgagtgtttaatttactatatattttttttaattgagggagggttttgcagaggtggagtgaaagaagaggatcactccgatcattgtcttttatttccagatctttttgagtaatgaaaatgcacttaaaaaaaagttggggtctagttgcagtctcaacccttgaagtggtggcctctgttgactgtctcgaggatatttactttgtccatcttttaagaaaataatcctttatgaatagtgataaataatcccacatttctcactatgactagttatttttaatgggcaaatttctgtttggaatgtaagatggactattttattataagctatttctcccattggcacattggcaatttcatatttgccaatactcagtacttttcctaaaatgtatatttggcatatactttgtagttggatttatttttgtttattatattataagcacatagcctgattaatcttactcttcagttaactgggatgttagtaaatcactacatgtaataaaacttttcatttatttctcttagaagtttctgtgtcagaagttcacactgtgcttttaaaataaatagggtttttttttttggttttgtttgagacagagtctcactccattgcccaggctggagtatagtggtgcagatcatggctcactgcaatctccacctcccgcactcaagtgattgtcccacctcagcctcccaagtagctgggactacaggtgtgcgccaccacacccagctaattttttgtattttttagtagagctggggttttgccatgttgcccaggctagtcttgagctcctgggctcaagcgatcctcctgcctcagcttcccacggtgtaaaataaaaacaaataagtttttaaactttatttgcctaagaatcacgaagggaactttaatgaatctatgacaggactgatgaatctacatttaaaaaatcttcccaggtaattctgattaaggtgtaaactgtaagtcaaaagtggcacccatttctgtcaggtgtattcctaaacgacagagaagataaagaaatagtcctgaaatgtgtgcatcaacacttaaaaccatagacaagataggagaaggaggcaaagcaccaataaaaatctccatatcccatgtacaaaaccttagaatacagagtaagtaactggtgttctttggccacaccaagggagcaagccttatgctactgaacaccttatgcattcattattttcccattacacaaaaaatgaagttgatgaattttggagtaagatagttacttgttgtgtaaaattaggtaggtggacaggctctcattagtataatggagattgaactgcctatctttaggcttagaattaaataaattaaaagcatttactcaaaatatctgccatgtaagaggttctcattctcaaaggatagctattttttgtttttaatgacaacatgttaccatagaatcattttaattatttccttgtgattaataattagcactttaaaaacagcattttcttgatgtttccttactccatcttcacatgccaagtgctaagagtgcttagtaacccttagaaatctaagaaaaagtagataggctttatgtgattttgttcaagcctttgtgtaaatggactttatgtgatttggtttaaacctttgtgcatttcttagtctggaatccataaagagctgggcttctgcttttttgtctttatgtatgagtgatacttttgccttgtagaaggaagtgagctgaactgaattctaggtcagcttggcagtgtggtccattattgaagtgtctagaactagaatgtgaatggaagtaagagattaataattgcaggatatctagatttcctcatacagtaaatacagtagaaagtcacaggcaaagaactaaaagactggacttttctggagctggatgattctgagcagttacctaacttctttgatccttgattattttgttgttagaatacatcaaagcctattcccagggtggttgttagggttaaacaagatgttatcagtaaaaactgttttttcaaatgtgaactacaaatgatttatattactgtttcctgtcctgaaagttctggatcttttaagcattagtatgcttttttttttttttttttttttgagagatgtctcagtatgttgcccaggctggccttgaacttgtgggttcaagtaaacctcctacctcagcctctgaagtagctgtgaccacaggcacatgccactgtgcttagctaaatgctactatgcgtattgactgagatttttctgtcatttaggtaatatgccctgaatttcaagttgaaatagagctttttgaaaatactatctttgggtatgagaatctttttttatcatttattaaagtggcaacatttaggttattgtttgagatgtttttatttatttttactttttgttacttttccattttaccttctgaatatgattaagcagctgtaaccctactatattataattccctgaactctgtagtctcccctgcttagtgtatggccccagctgatcatattaccatttactgatgacacatagacttttcatagatgcctattgaaataagtgtttgtgaggataaggggaacatggtgtagggagagggctttggtctaatgtatgtaataatgtctttaaaatgaatcaaactttgaagatttcctagttttaatagtttttttaagtgtaaaatgttactaacataaaatttttgagtaagaaaactatcttcttacggcttaaaacattatcttaaatgtaataaattaatttcttaagaaaagagtgacatgtccatgataaaatttcaagtggtgcagacagccattgttgttatttcttaagtatccttctggagatattttctgtttttaccaagaaatatgtgtggatatctccagagattttttctttcaaggttgttaatggcataatggatttgaaatcttttgtttgtaagctaaaagtttaaaatttaagtttctaaggacagattgtagaaatattatggctcaaagtttactaaaatgtaagttcttttttttttttttttttttgagacagagtctcgcttcttcgcccaggctggagtgcaatggcgctatcgtagctcactgcaacctccgcctcccgggttcaagcaattcccctgcctcagcctccccagtagctgggattacaggctaatttttgtatttttgttagagatggggtttcaccctgttggccaggctggtctcgaactcctgacctcaagtgatacacccacctcggcctcccaaagtgctgggattgcaggcgtgagtcattgtgcccagccaaaattgtacgctcttaaggacagatttttttcttagctatatggacttaatctttatattctgtagtctatataattatatactttaaaaaaaaatacagtggctggccgcaatggctctcgcctgtaatcccagcactttgggaggctgaggcaggtggatcagctcagttcaggagttcaagaccatcctgaccaatatggtgaaaccccgtctctagtaaaattacaaaaattagctgggcctggtggcatgcacctgtagtcccagctactcgggagactgaggcaggagaatcacttgaacccgggaggcagaggttgcagtgagccaagattgtgccactgcactccagcctgggcaacagaacgagactccatctcaaaaaaaaaaaaaaaaaagtacaatgaaatgtttttttagccatcttgctagatatatcacgtctggagtttagggaagagatctttagaggtaatgatgtgaacctagtcagtttgtctgtggcagtggttctcaaactttagtgcataacatcatttggaaggcttcttataacacacttctctcagtataacctcttagcacttctgtttgtttctatttgtcatcttgaattgtcctgggatacttaattcctttcattctctgtctcataacattttcagtttattggggaaggaggagattcctgtcagtgccactatgaagattgccctaggaaaaaggattttatctgtgctgttacctgtttccctcatttcattttccttggctactcttgactgggataaatttgtaagagactttagacagttcactgtagctgattggaaagctccaagtactgttaacatttataaccgacaatgtctgtggtatgtttgctcactgctttttaatggctagttttatctgcaaaactgttaatatgggcctggcactaaccatagtgagagagtgtattgttctcagcattttctttttactattatttcctgcagccttgtctagtataatagttacttaagaagagtaaatctttttttccatgtctttacttctttccccaccccctttaatctcccttcttttggacaaaaactacttttggggagtctgtagtcttttaaatccaaatatttcctttaaatatgagaagagaaaaaaaattaaacaggatgggcaacagacaaaatattttccaaataccacaaaataatttttaaaaacttggttgatgttgtttttatcattaataggattttgaattaatgtgaactgtcaatctactatagtttattttcctctttagttgtataagaatacaataaataatctgaataactgtagatagaaatgtgcatagttgtaaaatgggatttgccatggaaaaattttattaacactttagccttatttaggggtttcttggtgcggacaatgtatgctaatgggctttctctagtcatgtattacttctgtacaaatggggaattggctgctaacatgaggaggccagaggcagtgtttttaatgacaagaacaaataaagcctatttatgttaaagtatatgattagatttggacttctatgtttactcacctttcccgatgtctaaaatgcccctgccaaaatacattacagggatatttttttagcttgaatttagatttttttttttttctttgagactgagtctcactctgtcgcccaggctggagtgcagtggcgccatcttggctcactgcaacctccacctcccgggatcaagcgattctcctgccttagcccaagtagctgggactacaggcgcccgccaccacgcctggctcgttttttgtacttttagtagagatggggtttcaccgtgttagccaggatggtgttgatctcctgagtttgtgatccgcctgccttggcctcccaaagtgttgggataacaggcgtgagcctctgtgcccagccagatgtgtgtggttttttttctttttcttttttttttttttttagtgtgctaagaggccaggagcagtggctcatgactgtaatcccagcactttgagaggctgaggtgggtggatcacttgaagtcacgagttcaagaccagcctggccaatgtggtgaaatcccatcactactaaaaatacaaaaattagctgggcatggcgggtgcctgtaatcccagctacccaagaggctgaggcaggagaatcgcttgaatttgggaggtggaggttgcagtgagctgagatcatgccactgcactccagccttacagattcattccaactgaatctgtaaacttaaacaattaaacagctattttattgtattatttattttgaaggatgaatattctcttgaaattttagtgttatataacataaatctgcatttgttttggagattgttcactacatttaatttactgattaaattcttatgtgtactgatgatgtgcatctgtatgtaaacataagtttttattcaaacacaaggcaaaaaaatcttttttctctgcttggttgtccgataagaggaacacaaccccctattactcactaaaaaagaaaaactggaagaatttcaagtatttagtttcttattaaattcagatgggatgatagacctctaagttgaacttttccttatccttaatgggttgtatgcattaataactcttagcttgattctggcctaatttcttttaaagactctttaaggacaattaattattgtttatattgaatataacatattaggagggtgccaatgccaggtgcaaagatctgttggcatctaggattcctgtgtttttcttaactgtcaaatctgaaataaaaattcctctagatttcttagtctttctaggtaaagtgacacaaatttttggatatgagactgctttggtgctctttcttcctgcaccatgatgcccacctcatagtctttcagtcatatgcacattggacattttaaggccttatcttgtttgacattatggatctttcatattttctccttgagaaaaatttttccccctttgcttcaatgacgccatactcctcagatttctcctccaattctttggacattccttcataatctctgttttattacttccttaaatgttggtaccctttatggttctattcgagtcctccttgagaatctttttttttttttgagacggagtctcgctctgtggcccaggctggggtgcagtggcgcgatctcggctcactgcaagctccacctcccgggttcacgccattctcctgcctcagcctcccgagtcgctgggactacatgcgcccgccaccacgcccagctaatttttttgtgtgtttttagtagagacggggtttcaccgtgttagccaagatggtctcggtcttctgaccttgtgatccgcccgcctcagcctcccaaagtgctgggattacgggcgtgagccaccgcgcggcccttcttcagaatctatataggatttctcagcaatctcaacccacccccttaacttagttactatatgtatcctgatagtttttttttttttaaatatattgaagtgtaggtgacctacagtaaactgcatttttttgcagtgtgcaattcaacaagttttggcacatgaaaccaccacactcaaggtattgaatgaacaatccatcacccccacgagtttacccgtgttcctttgtaatcctttccccagcccaaggcaactgttgatctgctttctgttacaatagagtactttgaattttctagaattttatataaatggaagcatacattatggactctttttttccctaaaatctagcttcattgagcacccttgtcttgagattcattcatgttgcctcttctcagctttgtttaggtttattccttcaacctttcggatgactctccccagccttggagtatttcctcatgtgcgtaagatgctgttcaatacttagattacagagagatctctgctgtttttttcctcttcagaactctgacctgaaaactagctaccttggcattcctggactcccatttccatcttttcaattcagggagagtgctggtctctgcccaggttctccctcactaagctgcagtaattttagagctcacctggtttgttttctgtctctcagggtcattgttttgtgctgccttatgtttagtctctgaaaactattattttgtatatttcatctattttttgttgttatttcagggatggtggtaaatctggtcccaattattccaacttggccagaactggatgtcattattgaatttactaatctatatttccagtcaatattttcctcttgagcttgagacctgtgtgctagtctgcctattggacattttctgcttttttctaaatcatcataattttctcctgctaaaccttcctgttcttgtattcctaacttgtgagtagtagcaccatctacctagtttttccaagtcattgccacaaatgttctgaattgacatatgtcttccatatttccccgcctcacccccatgttacgcatccattcaccgtatgttgtcaattttagttctagatattgctcagattcatctacttctctcccattctcattactaccacactagttcaggctaccagtatcaaccagttgaatcactatagtagatcctaattaatttatctgcctctagtctgctctttatcctgcagttagaactagttttcaaaacacaaatctattcatacagttttctgttttctttaggacaagtccaaaatatatttaaggtggtttacagcattcttcgtgttttcgtctttgctccctctgcccgttctgtctcacctctcaaatattctatccttcatattcttggaaggataccttgatacctcagatgtgatatgctttccttcatcttcagatcttgagatttactaccctttgcctgaaggagttctatcccacatttgcttatctctattagatatcactccggaaatctttcttgatcccggatctgggttagataccttctatcagcactctattttaattgcttatttgtctctttcacatattttacactgtataccccacaagggtaggaattttatgtcatatttttgtattgactttgtctaaaacagtttataacacatatgttaatattctgaattggaggcagtaatcatacttgactatagagaaagatgctctgagggcaaaagcttgaagtctttttgacaacctgtttctaaatttacggaccacaagggcagaggctgagttgctccatttcagaatattgttggaaatgtagtatctgaggccttaatacagacttcctgaaatccgaatctgcatttaaaggttgagaaggcatgctctaagtttattggttatcctttttagctacatgttaaaatcacctgggaaactgatgaccagtatttaatcctttggtgtaggtaggtcctgggcactgatattttggtaaaactagtgcctagggaattctaaggagagccaggaataagaacctatgttttagtttgaagtcctctctctttttagtctggaatttgagaaattgtcatttcatatttagattttgagctgctttcacacattctttgtaaagcctaaatgtttggagagtggcggcctggagctaattggggctgtcaggttggcagctgtggtccctaaagaccagtactcctcagactttaatgtgcatacgaatcacctgaggctcttgttaagctgcagattttgtttaaagagactgggatttgtttaaaggcctgacattctattcttaacaagcctccaggcaatgcattagaaaactaaaagagatgctacacctaagcaaatttatactttctcttatttccttaacttttcctatagagtaccacagcaatacctggcagcttagcgagctgaaagaattccttcaattccttgattgttattgaacagaataaagaataaagggcatttaactgctggcaatccccagtacccaagtggtaactccctctggggtggtgatatggtttggctctgtgtccccacccaaatctcatttcgaattgtaatcaccatgtttagagagagggaagtgataggattatgggggtggtttcctccgtgttgttctcgtgatagtgaattctcacgagatctgatggttttataaatggtagttctctacatgctcacactctcctgccaccttttgaagaaggtgcctgcttcgccttcctccatgattgtaagtttcctgaggcctccacagccatgtggaactgtgagtcaattaaacctcttacttataattacccagctattataaactgggcagttctttgtagcagtgtgaaaacggactaatacaggtggtaagtctctacgagaactaggctttatgaacagcttcccatgtgaagaagggaagccagctctcccagagctttggttgtttgatttatgggaaggagcatctcattgcttttggacagggtacaaaaaaaaaagctatcttttgaaccagtgtgttagaaatgatgcaaagctttgtatttatatggaaacacatccctctccattttaaaatttattgatcacatgtactgcctcattgttactatttttagtcactataaccattagattgacaagcccatgtctcccctaactcccccacactttgctggtgctttgaatagtattgtacttaaatcttaaatgcagtcatttaaaatttaatcatttgatgtaaccaaacataaggctaattggtttttccctgtctcttaaggaccatcacttcatttttgttaacctttttatcttcctctctcatgtttacagcagctgttttaacatgttttatgactttaagctgatctgacaatttggctattataggaagattttatatcattcagacacagtagtacctccaactgggcttgatttttctgtgatttacttcagtacaaataaggatgctataaatcagtttgagttcttaggcctcaactaaaagttgcaggattaaatgaattcctgttgtctacagttaaaatagtttgtctaacatttttctaaaaaaagaatttgaatttgaaatacaaataaaatgaggaggtgaattcttaaaaaataagcactgagggcaggtgcagtggctcacgcctgtaatcccagtactttgggaggccgaggcgggcggatcacctgaggttgggagttcgagacaaacctaaccaacatggagaaaccccgtctctactaaaagtacaaaattagcctggcgtggtggcgcatgcctgtaatcccagctactcgggaggctgaggcaggagaatcgcttgaacctgggcagtggaggttgcagtgagctgagatcgtgccattgcactccagcctgggcaacaagagcgaaactctgcctcaaaacaaacaaacaaaacactgcaaacattcactgaaaaatatttaagaaaattgaaattgcagcaatttaaaaacatatcctgctttttagtagaaagctcccattttttaaaagtagatcaggtaagagtttcaaaatgaattgaaacaggattttttgggctgggtgcagtggctcacgcctgtaatcccagtactttgggaagccaaggccggtggatcacctggggtcaggagttcaagaccagcctggccaacatggtgaaaccctgtctctactaaaaatacaaaaattagctgagtgtggtcgtgtaatctaagcaacttggaaggctgaggcaggagaattgctggaacgtgggaggtggaggttgcagtgagctgagatcatgccattgcactccagcccgggcaacaacagcgagactctgtctcaaaaaaacaaacaaacaaataaaaaaacaaacacaaaaacagaatttcttacagttggaatattaatttatttttttaactcaaagtagaaatgtgatttcaaatactttgttgttgtaggcagataaagctatgaccataaatacgtagaaaactatatttttaattgaattgaagttctatattattttattactttactggtgatggagaacataaatgtgaattcatgatacaacattttaaattcagaaaagaactctttgtcaaatactaaatccaattctttgcttataagccaggtttcactccctcacaaattaatttaaatcctcccaggaatgcacagtgtccctgccaaaggttttcacatggtgattgatgaaaagatttgctgaagaatatgcattctttttaaatacattttaggagcagtttaatatagaggttggaaaatgaaataaattcatgatgctccatattttgatcatgttttgtgattgaactttttccaaagaacttttgaaaaagacacattcccttcagaattacaaatctgaagcttcttcacaataaagctttaaaagtgacttgtattgaaagcttttctttaatctgctcacatccgcacatctcaggttgtggtctgtattgcagggtatatttagccaatgagtatctttgtattacttagtaaattaaatattttaattccactaatgctgttgaaaggtttttagggtcagttgtaaacttaattgctttcagcttttctttccttttttattaatgtggtaacatatacgtatataatataaaacttagcatcgaaccattttaagtgtagagttcagtggcattaagtatatttacattgttttgtaaccatcaccattatccatctccagaagtttttcatctttccaaactgaaactacgtatctagtaaacaataactcctaatttcccacccccctctggccaaccaccattctactttgtctatattaatttgactactctaggtactttgtagaagggagatcatacatatttgtcctcttgtgaatggcttatttcctctagcataatgtcttcaaaggtgcatctatgttacagcatgtatcagaatttcctttttaaggctgaatagtattccattatgtgtatctaacacttcattcattggtagcttggtagatactggcttgcttctttttctttcatggcctagatttaaaatactgattgtaccgttgccttctatcggcttacaaatggtttagacatctactacagaagagaccaaggaatttaagcatcgaaattcccacctggccccacccccccagcccccgccatttttttgtgagcccaggatggctttgaactcctaggctcgagcaatcctccccacttagcctccagataattacaggcatgagctaccaggcctggctcatcttctttgatttttcttaatgtcacttgagtcttttgtggcccagactagataggggaatagcctgatcatctggccagatctaaactgaaatacctgatgaggcagctgtatttggagaggctgagctgagatacggaagatgaagatctggtattgaggattcaggcttgtaagggaaagcttcaaatgcaaattatgcaccctaatttttttaaccgattcttttggttataatttactttttttggagattgcatttatttacactgatttgctaggtgtttgtatttcttttctgaattgccttttcatcttggtgtatttttttgttcggtcacttagaataaaaattcaagtgtgaagaaagaaaaataaagtttagaaatgtaaccttttgctttattttagaaatttttatttatgtgattatgcatttcctagatactagttctttctgttcaaggccatttactccagcacccaagtggatttcttgattgcaaatttattactataggatgtatttgtgtagaattatttcttcctattgtactggccttattcacacttctgtgctttaatacaatgaaaaattgttttgacattgaagttctgtattgagtcccacaagatattattcccttaaagcacttgtatggtaacttgcaaattgaacatttgaaatatcaaaatgaaagcacgcagtataaaggtctgcctttgaaggataatggcatgcatgtggggtactgttaaaaagaagattaactacattagcagcaccttgattttagcacagggatcagcaaattagtggttgtaggccaagtccggcccactgcctgtctttgtaagtaccttttttttttttttttttttttaataacctttaagctctgttgaacttgagtaaggaaagttttactggaacacagccacacctgttcatatattgtctgtgaccgatagattttggtctacaacaacagagacctatggtccacaaagcctataatatttactatctgtttttacagagaaaacatttgccaactcctggtttagtagatcaaagatcctttgatgtattttagtaagttttgcccaatatactgagatgtttatatggaatatgaatcctcatgtacagtcctttggcaatatacagatgagtctgaaggtccaatatttgagcatgcacccattgggaataaaaaaccaaaaatttaataactagcagttttgttgataacaaggtacagtgtcaatgtagcgtgtagccttcctttgcagctcagcagatattgcaagaattctaacaaaatttgcttaaaatgtgtcataaaatgaaatgctttaaatatactttaattgtgaagtagccaatacattatagatctaacctcattgttttaaatggttgcacactacattatcttatggatatggaaatttaactcaggggttctcaaaccctgggctgcagaccctaccaggctatacagcaggaggtgagtggctggcaaacattacggcctgagcgccacctcctatcagatcagcagtggcattagattttcttaggagcacaaaccctattgtgaactgtgcatgtgagggatctaggttgcatgctctttatgagaatcttaactaatgactgatgatctgaggtggaacagtttcatcccaaaacctaccccctgctacagcccagtccgtgaaaaaattgtctttcatgaaaccagtccctgttgtcagaaaggttgaggactgctgatttaactatttccttatttatttatttgatactaggtctcaccctgtcaccaggctggagtcccttggcgcaatcatagctcactgcagcctcaaatcctgggctcaaaccatcctcccacctcagcctcccaagcagttgggactacaagtgcacaccactatgcctggctatatttttaaaaattttttatagagacagtgttttgctatgttgcaccgggctggtcttgtactcctggcttcaagcaatccttctgcgtgggcctctcaaggtgctgggattacaagcatgagccactgagactagctctatttccttattgatgggtatttagactctccaactttttaatatgacaatgctataataaatatcctaacatacatgtattgtatgttatatatatccttgacatatatgtttttgtatctagtgacctatggtatattatatataatatatcataaatgtccttaacataaagaaaaagctgccctttgtaatacccaaactagactaacatctgagcctgttgactatttcaattaaatctgacctcttcatatagactcagaaatatggtaaaaaggaaaacatgtttatgatgcttcaaagtattagttcaatccttgagttttctgtgaaggagtaattgagataatatggctgccctttgccctatgtaacaaggagacttttaaaattaagatcgtgattggcttccagttaaggaatcacagtgttcagctagggccagtggtatttaccaactgagtctgtgaaaacattcctttttaccctcagatgctcactcagctttctgttttccaagtgacattattatagcctttagtagtcagagaaattaaaagcacattttaaaagcatgaatagcagagtctccctacagtttcacaaaattactactttttatgatattccaagtgtaggaggatttctgaaaacttagagaagttaattgctaaacgaccttttagggtttttttatttttttttttctagcccctgttagagccatcctgttgcccaggatggagtgcaaaggcatagtcatggctcattgcagcttcgacttcctgggctcaagtgaccctcccacctctgcctccctggtagctgggactacagacatgtgccaccatgcccaactaattttttttttttttttttttttagagacagggtctcattatgttgcccaggttggtcttgaactcttttgctcaagcgatccccccgccttggtctcccaaagcattactgcgctcagtcccttttatgcaaataatacacattatagaagtttaaagcatatatccaaatgtgtgtgtggttgttgttgtttgggttgctcaataacttctgactttgtttaattgaaaagtggaaatgtggccacttaaattttgggtatgactcttcatttaccgaaccagcaatgtaattaagtcttcagctaggataagaggaacattaggaatccatcctgtcaaatttctgggcacagtaccttcttggaatgctaaatgcaccaaatctaatttattgaccatctcttaacctaccagtctgcagtcatctttagtcattttatttactttatggattttataaagattttgaggttaggaatgttagaacaggggtcgccattctgtggtccttggcctgttagaaaccaggccacacagcaggaggtgagccgctggcaagcaagttaacattactgcctgagctctgcctcctgtcagatcagcaggggcattagattctcaaaggagtgtgaaccttatgtgaactgtgcatgtgagagatctaggttgcatgctctttatgagaatctaatggctgatgatctgaggtagaacagtttcatcctgaaaccatccccctgcccctgtcttgtgttccatagcaccagtgcctggtaccaaaaagattggggaccgctgtgttagaaaactatattgggaatttaattttgatacttagttggttatcaaagggatttttgcctttatattatactttttttcatgttcaactttcccttccccagaactggtgctagaagtaaattatctaacttgaatcttagatttttaatctgtaaaaggcagatatgcataaagactacctattttgatgacctaactctgcctagcatgtagtagaagttcaaacaaaatggtagttctgtcagtatagctgctagttatcctcctgtcttatctaattgctttcttgtttcttcatcttgtctattaactgtttttagaactttaaacttgcagtagcttcagtaattaattttacctgatgttgattcctatcttgggaaaatttccctgaaaaagcatgtctgtggtcatcctgtcttatgtcagtgtaaatcccaaaaaacttgcccctaatttcaaaaagttaaactttgtatacaataacatttgtatcaattttttaaagtttccagaatcacatttaaaggaattatagtttaactttaaagtttaactttaccaccaaatttagtaattatctctgcagtagtatgcctgaaagtttagacattcacatactactgccatttctttccttttctttttttttttttttttgaaatggagtcttgctctgtcaccagactggaatgcagtggcatgatcttggctcactgcaacctctgcctcctggtttcaagcgattcttctgcctcagcctcccaagtagctgagactacaggtgtgtgccaccacacccagctaatttttgtattttagtaaagatggggtttcaccatgttggccaggatggtctctatctcttgaccttgtgatcctcccgcctcagcctcccaaagtgctgggattacaggtgtcagccaccgtgcccggccaaaatgcctatgttaatatttatttgatagtttacaaactttgccttgcctaagcaataatatctgtgaaattacaggttctatatactagctatatacatttttaatgtatattaaagtaactacataaaccattttgtttgtgtactacctaattgtattgaattatctatttaccgcttcaggcatctcttaaaagatcatttaacctctgaatataattctctttctccttttttctctttctatataaaacttgaccacaattaagtctttttctttgatagtgagatatgggtttttggtggacaggaaccattataaagatttgttgtatacagtaaatctgataaatatgaacatatggaaatatttattacacttgtttcattttaatatttggagacatgtgttggggaaggggactggaaatgccagtattttgtatgtagactttcactccttatttctcaaatggtttgttctttacctctactcttgactattactgatgtctcagagtcagacatgtctttagttcagtatctacagagaataaaccatctccatgggtgtgggatagttgcctgactgaggtggcatacggggcaggagtgtccttagtactactactacagctttttcttaatcaactgaatttaagattcactaacttcctgcagactttcatcatttctccagctttcccccatcccttccctttgcctttgggagcttctcattgaagcatttaagattttggatttttggattagggatgctcaatcaatgtaatgcaaatattccaaactctgaaaaaaacacaaatccgaaacacttctggtttcaagtatttcagataagggagactgtacctgtgttaatataaaaataattcttttaaaaatggttgaagataatgaggctcaggagatggagggacatgcctaaagttacatggtgacagaacctgattccaaaacacatgttcttaattgtgaatcctgggcattatctactaaaagctgttgcttctttgaattgctataatcaaatcaccgtgagctggcccaatgggccttcagattatacaatgaaacactatagttaggagctaatagctctgaaaatatttttggaaatgttccatataatattaataatgttatcattgatagggtaatgttaccaagatctctattaatttatgagttttagatgtataacactggatgtttttcctaagtactgttaaaggaagatgactttgtacaggcccagatgagaacagaggagcatttctccctggagagagctgcagagaaactggactccttaggccacagctggatttcagttaattagccctcagatatttgtaaatagagtatactagcccttacacagcactaatggcctttgggtaataatacaagctagtcagttaatatttcaccaagtttagtgacagttccagtgtcatttcagtttctacccatatgctgcaaaggtacccaaacttcctctgttcatcacactcttagtgggctaagtaatcttttcatgatgtccttagatctaaagaaataccagatagttttattttcttagtagtttggtccaaacagtataagtatttatgtcctaataacttagtagccatttgaataaataatatatgaattctttgaagaaatatttttacttcattcttaagtaaccaacatttctaatgggatgtgtgcatctcttggacactgtacaacttcttaaaacttggagtccgattagaagctctaccctcatttcctattccacattgatttttgtgtgtgtgtgtgtgtgtgtgtgtgtgtgtggtgggggtggagggagcatgattcttcttttttacattacagagactcagttttgtaaagatgtgatgctatggaaagtataataggatctaattttgaaactggactgttgagttagggttcatcagtattctacagattacctaaaattactttgtttccctcagaaatttaaagtttgtctgaggtgtctgagttcactgcactttgatgtgttgtttggaaactatcttagggttaggacatgtaaatgcaaacctgtttagaatctaagggaattttaaagcctagtttcagtttagacttcaggtaaagttgtattttctttaccttggatttttagttttactttatgtgaaaatgtttttgctaacaaaataaaaaagcaggaagctttctatctttgctcacagatttttttaaaaaagaatcattgacgaaagtttttgtttatttaaaactttctgaagcacagcactctttaccaattatttgataaagggaataggaaaacaactgaggtagagagaaatggaatgtttaccttctagtgtcctatttaaatcttccacttaggtgactggctcaacagtaacgtgttttgaacactgaagagaggtatgtaaatgaatacttcatggttgtaattgttaggcatataatttgatgcaaactatgtaatgagagaggcatatgattatcattctttaaaagacgctgcacaagagcatttttcagtaaatgtcaaagttgagacaaaattaacttgttttatgtagacattttgttttctgtctttcttataaaagtcttgttctgtcctcctgaaatgagatcaagaactttgggtccttttaaaataaagcaaaacccaatgatacgggattttggcaatttaaacaaatctaaaatttcaattacaaagaagagaaaccacataataagcacatttgtactgaaggaatattttcccttctaaacaactgatgtatgttaatgtttgatttgacacatctgaatcaatagtgttattgtcttaccatttgcttcatacgaacttgtgcaaatttatagagcagcatgacacatagcagaccaaaatccatgtttgttcacctagtaattatttagtccaatgtcagtgaaatattttttattttgttaacattctaaccaaacatttacatattattttatttttgctatgtaaaattttgatattccctgacagctgaaaaatagcaggtaagtgtttgagtatctcttttcacatagctgtagcttactttgcttttacttttccctttatagattagagccacgaatataaataaactgcaaatgagctgactattcagtggatgatttctgattaggatttagagtaggttttgtatgtaaatgctgtgttttatgaaggctttttggtggaggaggaacttctgtaaaaatttcttgttgaaacatcagaattagctagtttcaaaaactctgctagtagacattttggcaattttatataggctttgaaatgtctttcaagtgttgtctttgtactttcaaatagcatttaaatgctcattcacggcagggggtacctggacgttttgttgagaagattttcttggtttctacttttaaaagccttgataagaagtttgtgttgtaccttaaatttgttatgtatattttcattacttctttgactattaagtattttggttcatataatctgcagggtgccagactaaagcaaataaaagttaagggtactatataaattggtaaatatctaacttagtttcctccttcctccctaccttcttttctttcctccctctgatatttattaagtagctactatatgccacacacattgaaggtactagtgagtaaaagataaatggtggttcttgttacatagtatagaaaatagggtgcaaaaattgcctgaaagcaagatttgcctttgtaatacgaaatgtgaattgattggtatataagaatatagcaggaaccaaaaataaggacactgtcttaagccttaaacaatttaaaagaattcctattatagtaattaattttagtctcaaatgaagagctggtatggttttgttttttctttgagttgttaatcctaatgtagaaatgactttactgttacctcaacagtagcttgctgttaacagaaacgatgttttgcattccaggttccaagtgttttatttttggttccaataagatcagctattatgttgttaatggactaagttttgtctctctcaaattcatatgttgaaaccctagcccccaatatgaactgtatttggagatttgcagatatgacctctaagtaggtaattgaagttagatgaggccttaagagtgagactataaagccagtatgactggtgttcttactaggagggggagagagagaccaaggatgcacacacacagaaaaaaggccaaatgaagatacaatgagaaagaaaggtgaccatctgcaagccaaggaggcaagaggaaagatcaaacctgccagcagcttgatcttggacttccaacctccagaactgtgagaaaataaaattctgtgatgtaacccacctggtctgtggtattttttaatggcagcaaaagcaaactatttagtaatacatctgacctaatgtaggcatgtgcttgataaaccaatttttcttgttgtcctgaagttctctacaaccatagttcatacctcaatcttgggctggtgtcaagtctttgatttcttccaaatacatagattcccagaaagtataatagctttcaagaaatactaattttcttgtatgtagtcttatctattaagcagccatatattgaagatatctttggtaagtcactataatcattgatttatttatacttttattccctttttatatactagtatattttaaatgataatgtgttacagtttggcagagtttcatttctcagtggcacataaaataatggtatgttttcaatcagtggcatcttagattgaatgaaatacattttttacattatatcccacctctccaggtccccttgtagcatctcaaatatttgtgattcttcaaaacaatcaggaaaggagttattatgtagctttctgtagtaaatcatatgacttttttttttttttttttttttttttttttgagacggagtctcgctcggttgccaggctggagtacagtggtgcgatctcggctcactgcaacctccaactccctggtccacgtgattctcctgcctcagcctcccaagaagctgggattacaggaacatgccactacgcccagctaagttttgtatttttagtagagacagggtttcaccatgttggccaggatggtctcgatctcctgatctcgtgatccgcccacctcggcctcccatagtgctgggattacaggcgtgagccaccgcgcctggccaatcatatgactttcttaatcctgttaatattctataaaatatctgctgtattggagagcttgttttatataagtaaaaatagagaataagctaattgtcataaaacagtaaatgtggtctcatagttaagagaataggctcttcggacagaatgtcttgagttcatatcacagctccatcacttgttagctgtgtaactttaagcaaatgtttaactgctttcaaatccataaagtagggataaaaatagtacctatctcatagggttgtgaaggttagaagagttttgctctgaaaagctcttagaacaatggctgtcacgtaggtgctatgtaattgttagctgctattgttattgttcctttgagttaatgaatagtgttttttcttaaacatttaaaaaaaataccaattgcctttctgtataagcaacaaaacctgagaattcaaggtaaaaatagaatttaatcttatctaatgaaagttaaaatgaacctaacatttaatgatgagtgtgttgtatggtaattagataaaattaggattaaatttttagtcctctgttcattttctttagtatgtaaccaccgccaatgtaacagaatatacaatttagttatttcccttaacttcaaactctcagatacacagacacataactcacaagctctcatccaagatccttacgcatcaaactattataggacatagtttctttaatatgtatccctgtgttcccaactaatcagtcttctcctaagtcctttctcttttacatgccagggatatgtgtattcagatttttatttttattttttaaagacagggtcttgctctggcacccaggctggagtgcagtggcatgatcacggctcactgcagcctcatcctggacttccagggcccaagtgatcctcctacctcagcctcccaagtggctgggactacaggcgcacaccaccatacccggctaattttggtattttttatagagacagagttttgtcatgttgcctgggctggtctcaaactcctgagctcaagggatctgcctgccttggcctcccaaagtgctgggattataagtgtgagccactatgcccagcctattcaaaatactaatcagcttgagaagacagagtctttcttggtcataaaggttgaattgcctacttgggttgtagtatgattgaaggtctgcaatagaggaataagttacagcaaataggactgagtccttgagtcttggggtggagggatgggagagaagtggaggatttaggactaagggattgctaaggaaggaaaataaggagtcttgctctttgtgggcagggagtaggctctgctaaaatagatttatggccaggcacggtggctcaggcctgaaatcccagaatgttgggaggctgaggtgggaggatcacttgaggtcaggagttcgacaagcctggctaacatggtgaaaccttgtctttactaaaaatacaaaaattagccaggtgtgttcgcaggcacctgtaatcccagctactcaggaggctgaggcaggagaattacttgaacccaggaggtggtggttgcgcttagatgagatcatgccactgcactccagcctgggcgatagagtgagactccatctctagaatagaatggaatggaatggaatggaatggaatggaataggaataggaataggaataggaataggaataggaataggaataggaatggaaaaggaaaaggaaaaggaatggaatggaaatctcattcatttacttgatattcttaagtacttatacagtatgtgccagccactactgctaattgccagttaacatacaaggtagttttagtttgttttatatagacctaaacttttaatttttagtgagaggaaaaattcttgaaaatgaaggtatgcattatataaatttaaattatttttagaggaatatatgggtaaagggagaggatgtgcatagaagtccaggggacaaggaaatttaaacaagagtgtgaagtttcttgagagggaccagttgaggctaaagatgaactttacagacactaaaccacaaacgtaggttctgcagagaatttgggcacagagctttgtgctgtgcatgtggaaacctagccataactctccacataatttatacattaagtaaaatgtattgacataagtattttactaggaaaatatgttggctgggagaagccaagaaaattttaaaagtgaataataagaaagagaactggtattactagatattattaacttataatgataaaaataatatggcttttatgtagataaattggtgaaacagtattgaaagctaaaaatagggtgaggtggctcacgcctgtcacacctatccagcactgtgggaggctgaggcgggcagatcacggggtcaggtgttcgagaccagcctgaccaacatggtgaaaccctgtctctactaaaaatacaaaaattagctgtgcgtggtggcatgcgcctgtaaccccagctactcaggaggctgaggcaggagaatctcttgaatccaggaggtggaggttgcagtgagctgagatcatgccactgcactccagcctgggcgacagagtaagactccatctcaaaaaaaaaaaaaaaaaaaaaaaaaaaaaaaaaatatatatatatatatatatatatatatatatatgactccatctcaaaaaatatatgtatatatgtttatatataatacacacacacacacacacacacacacacaccccaaatataatgatagcatttggacttgatagggaggcaatagatctagagtccctgggtatgaaccctgagtggggctgagggaatgctgtactccagtcggagccattattcatacaacccactgccgttgttgcaattctgtattctgtgtacatagttgaaacaattggctgttatcaaagtagaaaccagtagagtccaacttcactacacaacaaattaaatatgagattagttaagttaaaaatgagatagtaaaaataagaaaatatgtgttgattagatcttggagtgggaaaaactttcttttatagaaccacagggagaaattgcaaaagggaaattaaacagaattaaaaggtaaactagaaaaagacattaacaatatgttggacaaagattaccattcttgttatatactgcttttagaagtactaagaaatgaaattgacagacaacatcagtgaagaaaatgaagatacataaatatataaagccaataaaaatatgacaaaagtttatcctattaattaggattcagtgaaacccctatttgcctaatatatttggtgagagttgaaaaaataagggtgagaccaatcttacacaagctttctggggcaatattggcagtatttttttttttttgaaacccaaaagctgtactctgaagaatgacagtatgtttaaagagccataaaaattagagatacacacaaaaatttacgtgaaaggctatttaacttgtatgtctcatgacacagacaggattgaacaaatcacgttgtattcataagctgatataatactatgcagctactaaaatttttgttacaagagatgatgtaagtacacttcaaaatgggatatccacaactatttgaatttaaaaaagaactagttctcatagaaagatgtttaccacagtgataatagttggttaagattaagaatgatttttcttttttcttttttttaagatgttaatagttttgaaaatttgtacgttttaaatttactcagttcccaagctttctagtttagaggtatgttgtatgtgtgtgagtgttggtgtgtatgtagcagaccgtagcatattaatctatgttcattataacatagattaatacgtttctttctgctatccagttagaagacgtcatttgtttattatgcccagttcttttcacatagagatacttaataatttgaccttatttcaatttatcttttttttttttttttaatgttcaatgttgttgttgttgtttaatcatctcacagtaacttttggcttaggagccagggatggaaggtgaggtaaagctagggcagaggtcgagtgatgacagaatggtatatgctagataaaagaaggactaatggtagatgaaaagggtattaccagagaaggaggcggattaaagaagtggcattactgataggattgacatggtctccctgaagaaaatgagtggaatctattttaatttccctaatacctttcatggttatagtaactcattttggaaagcacaggcacttaatccacacacatggtttgtaattgtgtgatcccaaatagactgccctgcccatcccccttttagggagctctaattctttccccaagaagctttgcaaagattgcttacctgattattttttagatgtagtgggcagtcacagtttttgaactacatttatataatttattgtacataaatgcagttgaacttacttggctgtttaaaatctgtatttcattttagttctattgtagttatttttctcattctgattcgtaatttaaaagttgtcatattttccttattagagccttgttgaggagtgtttatactttgcaaaaatttgttcaaaaattaaaacacctaagaaatttgtgtggattcttaagatgtacatatgttgtgtctacaggcatatttggatagaagaaaatgagataaaatttttttaaggattctgaaaatcgaaggaacaagcattataaggaatgtcagtattatgtaaaggattttacgaacggttgtaaatattttctacttaaaaatgaataaactattgcattcatttgtaagacttactacttatgagaaagagcaaatgggaaagtagagaaaggaatgtgaaacaatatctagttgaattctttcaagaactagatagtagatcacaatttaagctatcaaagtatcaaaactttggcttgagcacttattaaaaattaatttgaacagttcttatgttttatgttgaaatttttaacattgtattttcttgtttagttagtatgcatagttttagataaatagtagctgtgaatgatgattgccttatgtgcttaggtttacccctactgttcaagagttgttattaatataagtaaaagttatactcttctccatatattagaaacatttaaacgtgttaatacagtttttgtttaatagaggcaaatggtatattgattgctttttctgaactgagttttgtggaattctgttttataaaattgataggaaaaagctgccatgagatgaatctttttgttatttagtctatgaacttattaaatttctatattaaaatctttgagctgtagtaatagaaatgttagtagtaggaaactattgcctttaagatttctaagtcaagtttatttccatatttaacatatatatcactgtaaggttagtctttcaaaagcagcatgttttatctcatttgttcaagaaatactatgattggctgattttttttgtatttatgacttcatgtcccaattcctgtttagccacaatgtctttgtaatacagtccagtcagtctagtctctaccaaacaccctagtatttagttcagcaaacatttattgaatatgtgcaacatacaccatgttttgtaataacaggagtgtgaaatactgtggtgatgataatattgtgatggtgcaatctgttgccccaagcaaagtcataaaactatcagaacatagcagtggctttcaaactttttttggacagataaaattatgctttattggtgacacaaatatgaatagttttacagttaatgacattttccaaaatggcaagcaatttttaaaaataagattataaacaacatatttcctggattttcaggatagccgtcttctggaaaaatctttgtatacatttacaaatcctgtacttctcctgctttgtttttataggtaagtggttgggctcagataattataaacttatttttcacctgctggctgactcaacattacattctccagttaaacaaggtgtaggtcttttctttcttaccggaactgtgttttcaaattgcaatgtgggtagcattccaggtttctgctccataaccagtaatatccctcagtcatcaaggtgaccaaaatgcctccacagaatttcataataccttttaggtattatgaaagaatcactgagcccagagcattatggccaaagtagagacttgccccagagacatacttggagaagatactaaccctactaccaggtcccaagctatgaggggaattaaataagttccagttgagacaccacagggagtctttttcagggagccagccaggttttaatctgcatctgacaatagcaagatgttaatcactgagcaggaattttaggcagtagaatggaataatttggaagggagaggaagaatgcagtattggaacagattaggatatgtgaggttatgtacagagcaatatagtaagtgagaatctgtacagtgatagatgagacttggggaagctgggtctgctgttagtgactgaggtgtaaacttggaaatgagaccttatagaattcctccagatagcctctttaaaattaaaaaaaaattatgtaaaaacgttaacatacagaaaactaccaagccaaatgaatccttatataactgtcatccagcaataataatcatcaacccatagtcactcttttttttttcagctgcaattctcagtaattctgtgttctacaaagtgactcagtatacttacaagtaatctgaaacaaaagtttggaaaagtgctcactgctattgtctattctgttctttttcttaaaaattctgggttgcaatgcagtaaattgatttcataactaacaaatagttacacctggcagttggaaaattgagttcaggttttggagttagactgcttaggttggagttctgactgcactattcaacaaatgtgtccttaagcattaattcttatcttgtcccctcttcctgaatgtacattgtgtgtacctcctaaaatttttgtgagaattatgagatactggattttagtgcttagtagtaccctactttaagtgtcagactgggatctgaatctaggtttccagttctaaaatctgagttcttgtcttgtagttgtgaaatctaacacccactttacagaagattatttttttaaaaaagaaaaaaccaagagataaatgtatccttatcattcatacatatctttatatattaaatttgaagcatttcccaacattattttgaaaactgttttcagataatattctattctccagaggcagaagtgttatggtacagatgaataaaatatgtatttacttatagttatttagtcaaaacataaattttattgcatttttaaactgtatttggggatttcaatcatatacagatgtaaggagaatcatataatgaagtctacctgtactcatcttcagtttcaataattttcaactcatggccagttttgttttatctataccagcacactgcccgtcttacctcttgtcttattttgaagcaaatcctaggtggcatgttatgtcatctttaaatacttcagtatacatctctaaaatatatggatttttttttaaaccagaaggacaatgtcattatctcacttgaaaaagttttaaaaagtagttccttaatctctcaaatatatattcatgttcaaagtgtttcttaaataatttttaaagtagtttctttaaataaggatgcaaatgaggtgagtaccttgttgttggttcttatgttctttgagtttcaaattcatatatctcctttcccttcttttctctttgcaatttataagttgtagaaactgggccatttggtcagcagaggcttgtttttatatgacagagagccaagagtggtttttatagttttaaagggctgtttataaaagaaaaacaacaacaaaaaaacaaacagctgactttatgctgctaaatcctcaccaacaattggtatcgtcagtcttataattttagtcattctggtaggtggttcattatggtttcagcttgcatttccctaatgacatgatgttgagtgtcttttcgtgtgtttatttgacatttctttggtgaaatatctgttcacatttttggtcatttttaattgggttgtttttttaattgtgttctaagagctcattatatgttctggctacaaattcatcaggtgtgtgtttttgcaaatattttcttctagtctgtggcacgcctttttatttccttaactattttttgaatagcaaaagtttttaattttgatagtttttttgttttttgtttgtttgtttgtttgtttttgagacagagtctctctcttttgcctaggctggagtacagtggcacaatctcagctcagtgcaacctccgcctctcggattctcctacctccacctcccaagtaactgagactacagacatgcgccactacgcctggctgattttcatatttttagtagagacagggtttcaccatgttggccaggctggtctcgaactcctggcctcaagtgatccgcccacctcagcctcccaaagtgccgggattacagccatgagccaccgtgtccggctatgatagtacattttgagcttatttttgtaactgatgtgagataaaggactgaagttaactttttccttttagtgggagggtatatatggatatctatttgttacagcaccatttgctgaaaagatcatcctttcccagttgaatcttcatgacatctttgctaaaaattaaagggccaggctgggcacatggtatgctgcacgcctataatcccagaactttgtgagactgaggcaggtgatcacttgagcccaggagttcaagactagtctgggcaacagcaaaaccccatttctacaaaaaactaaacaaaacaaaacaagaattagccagacatggtggcaagcacccatagtctcacctacctgggaggttgaggtaggaggatggattgagcccaggaggtcaaggctgcagtgacccatggttgcaccactgcactccagcctgggcaacagagccaagaccctgtctaaaaaaaaaaaaaaatatatatatatatatatatatatatatatatatatatatatatatatatgtatgtatatatatatgtatatatttctatttctggactctagtgcattcttttgtatgaatatctttacgccaataacacactcttgattactctcactttataagtattgaaatcaagtagtataagttctttaattggttttttttgttgttgttgtatttttttttttttttttttgagacagagtcttgctctgtcacccaggctggagtgcaatggcatgatctcgactcactgcgatttctgcctcccgggttcaagcgattctcctgtctcagcttcccgagtagctgagattacaggtgcacgccaccatgcccagctaattttctgtattttagtagagacggggtttcatcatgttccccaggctggtctcgaactcttgagctcaggcaatccacctgcctgggcctccaaagtgctaggattacaggtgtgagccactgtgcctgtccaacttgatttttctttaaaaatgttttttcagattattttagatcctcttcatttccacttaaattttgaatcagtttgatagtttctacaaaaactgttaggattttgattttaggattgccttgaatttatgtatcaagttgaggagaaattatcttattgacaacattgagtcttcagatcccctaacatagcatatttttccatactgaggtcttttaaatttttcttagcaagatttttatagttgtaatgtaagggtatagtgtgttttttgtattttgtttgtattttaaatggtatttttcttcagtttgaattttcacatttattggttgccattatataaaaatacaattgatttttgtatcttgcgatcttcctaaactcatttgtcagttctggtagtttgtttttaaataagtccttaagatattctatatagaagataatgccatctatgaataaagatattttactttttcctttccaacatgtataccttttctttcttatgcttaccttattgtcctggcttggactggcagtatgatagatactgaatagaagtggtgagagcaaaaatggtgaaagcatcttacctgattcttggtcccaggggaaaagattgatttcttttaccactaaatgtgatgttagatatgggtttttctgatcagattaaggctattctcttctaagtttgctaagaatttttttgtgggttttattggcatgagggtttatgtttgtgtcatgctttttactaatgtattggtgattatatatttttctcctttgtaaagatgatgaatcactgatttgaaggttaaacaaagtgttttactgggatagaccccattttggtcattgtccttttttatatattttgcattttttatgctaaaattttgcaaaggcctttttgtctgtctttaccagattacattggtctgtagttcttattattttagaattttttttttttttttggttttggtaccagagcattgttggcctcaaaataagttgagaagtatttcttccatctagaagaatttgtgaacagatggtatttctttaaaagtttgatagtttaccaaaccatcttggtttgatattttctttactttctttactagatagagagctgttcaggttatatactcctgcttgattgaactttggtagcttcagtctttcacggaatttgtcaattttatcaaagttaccaaatttactggcataagccacacatggtggcccacacctgtaatcccagccctttgggaggccaaggcagatagattgcttgaggccaggagttcaagaccagcctgggcaacatgacgaaaccccgtctcttatactaaaaatacaaaaattagccaagtgcagtggtgctcacctgtagttccagctatttgggaggctgaggcatgagaattgcttgaacccgggaggcagaggttgcagtgagccgagattacaccactgcactccagcctgggtgactgagactgtctcaaaaaaaatatatatatatatattagtggcacaaagtttttcataatttttcttaatcttttaatatcatagaatatcatttatttttacttataatagtgattttctgtcttttttgttcagactgccaagaggtttactaattttatctattacttctaagaacccacttttggtttcattattttttctattttgttttattgtattttgctcttattttcattttcttccatttattttgggtttaatttgccctttttatagctttttaagatgaaagccttgatcattgatttgagacttctttttttctaaaataaatattcattgttataaattttcttctaagctctgcttttaggtggatttcaaattttatgttgtgcttttaaaattcatttgaaaatattttctacttgtgatttcttttttcacgtgattatttgtgaattaatttccatatatttagcagatttttcaggtagctttctgttactgattttaagtttaattgagtagtggtcaaagaacattcttggtatgatttcatcatcttatgtttgcacaaatcctgttttatgttccacaatatgttctgtcttattgaacatacagtgagttttcgaaaaacaaaacaaaacaaaacaaacatatagtttatttttgtggggggagtgttctataaatgttgggtcaaattgacagaattgaagtttttttttttatatctctacacatttcccaccttcatgttgtattaagtactgatagagaagtgttgaaatctccaactgaatttgtggatttgcccatttttattttcagttctttttgtttcatttgatctgaagctcctttatttggtgactacatttttaaaaactgtgtcttctggatgaattgacccctttatcattatgtaatatccctatttattcatgataatattctttattgtgtaatctacttcgataagactgtttcagcttacattagatatgtgttttatgatgcatcttttttcgtcctttcacttggaacctatttgtgtcattctatttaaatgtgtttcttgttgacagcatatatttgggtcttgcttttattattataacttctgcctttcagttgaaatggttagatcatgtgcatttaataattgaagtggtttggtttaaatcttcctgcttgatctttgttttctatttatcctatctgttctctccttttttttctgcctgcatttgtgttgagtattgtttaatcattcaattttatctttagcgttgcctaaaaagctctttgattggcttttaaagcagttgctttagggttaaatatctatatatatgtattatacatctttaacttatcacagtctgcttttatgtaatattataccatgccatgtatagtgtaagaatcttacactggtatacttttatttcctgcctttgtgccattgccatacattttacctttccatgtgttataaatatcacaaaatgtcattatcattttttctttaatcacttacatgttaaggagataccaaaataagaaataacagtttcttatatttattcatgtattgaccattttggatgttcttcattcctttgagtggttccacattttcttgcggtatccttttctttacagagaaacttcatttaacctttttttatactgaaggtctgctgctcagtttttgttatttgtagaagtctttatttttcttttctttttgaaacattttactacatttagaacctttatttgacagatttttctttttagtgcttaaaagttgtcatttcgaagggttttttgtgtctctatttccttcagttctgctctgatcttagttatttcttgccttctgctagcttttgaatgtgtttgctcttgcttttctagatcttttaattgtgatgttagggtgtcaattttagatctttcctgctttctcttgtgggcatttagtgctataaatttacctctacacactgctttgaatgtgtcccagagattctgaatgtatgttgtgtctttgttctcgttggtttcaaagaacatctttatttctgccttcatttcattatgtacccagtagtcattcaggagcaggttgttcagtttccatgtagttgagtggttttgagagagtttcttaatcctgagttctagtttgattgcactgtgatctgagagacagtttgttacaatttctgttcttttacatttgctgaggagtgctttacttctaactatgtggtcaattttggagtaggtgtggtgtggtactgaaaagaatgtatattctgttgatttggggtggagagttctgtagatgtctattaggtccgcttggtgcagagctgagttcaattcctgggtatccttgttaacttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttcttgaattgatccctttaccattatgtattggccttctttgtctcaaaaacctaggcaataccgttcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatgtgacaaagggctaatatccagaacctacaatgaactcaaacaaatttacaagaaaaaaacaaacaaccccatcaaaaagtgggcgaaggatatgaacagacacttctcaaaagaggacatttatgcagccaaaaaacacatgaaaaaatgctcatcatcactggccatcagagaaatgcaaatcaaaaccacaatgagataccatctcatgccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatgccgttactgggtatatacccaaaggattataaatcatgctgctataaagccacatgcacacgtatgtttattgcggcactattcacaatagcaaagacttggaaccaacctaaatatccaacaacgatagactggattaagaaaatgtggcatatacacaccatggaatactatgcagccgtaaaaaatgatgagttcatgtcctttgtagggacatggatgaaactggaaaccatcattctcagcaaattatcgcaaggacagaaaaccaaacaccgcatgttcccactcataggtgggaattgaacaatgagaacacatggacacaggaaagggaacataacacaccagggactgttgtggggtgggggaagggggagggatagcattaggagatatacctaatgttaaatgacgagttaatgggtgcagcacaccaacatggcacatgtatatatatgtaacaaacctgcaccttgtgcacatgtaccctaaaacttaaagtataataataataaaattaaaaaaaaaaaggaaaaaaaaagttgtcatttcggcggggcgtgtggctcacacctgtaatcccagcactttgggaggccgtggggggtggatcacgaggtctggagatcgagaccatcctggctaacatggtgaaccctcatatctactaaaaatacaaaaaatgatccgggcgtggtggtgggcgcctgtagtcccagctactcaggaggctgaggcaggagtatggtgtgaacctgggaggcggagcttgcagtgagccgagatcacgccactgcactccagcctgggcgacacagcaagaccccatctcaaaaaaaaaaaagtcatttcattgttttctggcttgtatagtttctgttgataagtctgctttaattcttcattttatatatatatgtattcttttttttttttttttttttttaagatggagtctcactctgtagcccaggctggagtgcagtggcacgatcttggctcactgcaagctccgcctcccgggttcactccattctcctgcctcagcctcccgagtagctgggactacaggcgcgtgccaccacgcctggctagttttttgtatttttagtagagatggggtttcactgtgttagccaggatggtctcgatctcctgacctcatgatccgcctgcctcggactcccaatgtgctgaaccactgtgcccggcccatactttatatttcttatatacttttgtgtataatctgcttccacccgtctgttacttttttgttttgttttttttgagacagagtctcactctgtcgcccaggctggagtgcagtggcgtgatctcggctcactgcaagctctgcctcccgcgttcgcgacattctcctgccttagcctcccgagtagctgggactacaggtgcccaccaccacggccagctaattttttgtatttttagtagaggcagggtttcaccgtgttagccatgttttgtagatctcctgatcttgtgatctgcccgccttggcctcccaaagtgctgggattacaggcgtgagccaccacgcccggcccctctgttactttttaaattttaatttttaattttttaattcttcctctgttacttttaaaattttctctttattactttgattataatgtgtatatgatttctttttgcttattctttttggacttgttgagcttgcatctgtgtgtttataattttcatcaaatttggataaaattcagctattatttcttcagttgcttttttccccctcatttctctctccttgccttctgagaccccaattatgcatgtgttagactgcttgatactgtctcacaggtcactttaatttatatattcctaatatataaacaactgaaaaataaaagattaacctatagagaaatggaaaactagaggtagacctcaaaagaaatgcaaatgactcttaaccataggaactgctgctaaaattacactgagatactttttttcaattattatattggcaaaaactgcaaaagtatgaaaactattgggagaacaggtaatgtcatactgaaggaaatgtaaaatgatacaatccctattgagtggaatttggaaatacctgccaaattgacatattcatttaccttgtgagccagcaatcctaatactaagaatctatccaggaaatccattgcatatatacagaaactatatatataagcctttctaacacatttttcttagagcgtgtaaaaaacccaaatgttcatcaataaagctctgattaaaatatggtaggtacatctatttaataaaattattatgcagctgaagaaaggaatgaggagaatccacttctcttaagtatggcagatacaggaattctcttatttctcatgatttccgccaacttcttcctccagatgtatttatcccagttagaaaagattgcttaagaatttctaggatgcttgttatcaaaagaactgcactggttgctagcagaattttggagagaagttgtgattcatcaagtaatcctatactaaaagctgcctggaacgttagatacatactgtatccacagggatactatgtgtgatgaataggttcccagttcagtggatagcagtgttgccatgggaaagagcattcagaattttaacttcaggtatcacagttcaccttccagttcatctccaagatgatttgtctcatcttggtaactcattcattgttttatgaaacatttaccgagtgttttgtttcttcctttcttttttcttttaatatactggtaagggagtctagttgagggggcaggaggagggaaagttagtgttgtggggctgggtctcagaaaatgaaaacaaagacaaataaaatagcatcccagtgctctgggagtgcgtggctacctgcctcaacttttgctttctgttaatattaatctatgataatttaagaattccaactttaagctaatgatgttggagcctaggtgagggatttttgagtccatatgctggagaataagtgatgattgctttcacacagtagaagactagagatgagaccattctttattcttttccagatctcatacttttgcttctcctactgttcattaaatgattgacctctcctcccccttttaaagcaactccttgatttaaaatgccttttatgctattttattctttctgttctaggacctctatcaggtatttttgttattgtagttttatacattttaacattaactagagtgtttggtcatacctcttttttaaaaaagtaatttttttgatatcttatgtattttttcttccagatgatgcaccactactttccaaataaatttcttcatgattttgattggaattttaatttatgtgttaagagactgttgacaccttcacaatactagatttttcttaagagcaggttttaatttgtattcttcagtaaagtcttatagcttttttcatgcacgtactgttttttagttttttaatggttgttactaaaaattttgtaactggctattgatgttactttgggaaattttttgcttatttactgaaaaaaatcttaactcataattctaaaatgtttttgttttttacaaaatcatttcctctgatggtaattttgcctcctttctaatgttaaaatcgcctattcttcttacctagttctatcaactagcactttcagaatgatgttaacaattatgttaatagtggacatcaatgtcttgagtctgattttactttaaattttgctggtatgttgtcattaaacaagatattgtctagtgatttgagaaagtttttgaaagtcctgagagagattttttttttctaataaggactaatttcttaacactttggtgtcccataccagatttctttcactgactctgtttccacctatgatatatcatttttcataggatacaattgcctatgtcatttaactagtcacttaactagtcttttcacttttggtcttgttcctgttctctgcattgctatttccaggttcttcccaaaaagaattttgatcattccttatcccaaggaactgtatagcattgtaacatcattccaagctatggagtgagaagtctaaacttcttgggttatctattatttatgttccctctatgcctttcgagtcctcacttttgtcaaaaactgtaatggctttgagatcataccccacttgctggctaacacgttagcttgtgtatgctggcaaaagatactagtctcctgggttagttagagtcaagaacagtttagactcagcaataacagtagctacagtatcataattttcttgtgctgtttccccaagccccactcttggcaggttgatatgacaagggccaggtgacaccaaatctcaacctgcatgctcctttcatttgccctttccatttctgtcctcagacttctctgtatcatcctaatgttgtaagactccatctcagctagaaaccatcattctgagcaaactatcacaaggacagaaaaccaatcactgcatattctcactcgtaggtgggaattgaacaatgagaacacttggacacagggtgaggaacatcacactctgggacctgtcgtggggttgggggagaggggagggatagcgttaggagatacacctaatgtaaatgacgagttaacgggtgcagcacaccaacatggcacatgtatacatgtgtaacaaacctgcacattgtgcacatgtaccctacaacttaaagtataataataataaaaaataataaaaaacactccatctcagacagatgctttcttccatgtcctccattgtagaccttgtctttatcaagcttggtacccctttcagtatgttcctcctatctccaaatattccagtgcaccttcttggtttgcacaatggcttcagtgttttcttctctctgcacaactttttttttttgtccaattcctattgtcttcactgccatactgttatactttgctgtgatcagttccttagtgtctctacaaagaggtgtgtggttttttttgtttttgtttttgtttgtttatttgtttttgtctggagggggtgtgagttctcatgcagaaacctttagggcagtgtattggttaggaatgtattcagttgcaaggaacggataacccagcccatgatgtgtataatggatagagatttgtttctattttgtttttcttatgtagaaagtgtagagttagataatttctagtgttgcttctgttttttagcagccttctcttgtaagcttttccaatatgctgttacatgtgtaattctctttttttatatatctgcaattccaaattgtagccattctttaaattacaagattttttatagtcttttctaactctccaggtaaaaatactcttcctttatatgctcatagaatataaagctagaaactgggcctttatcactaagttatctatctatctatatatatgtattatctttcctactagattataaattccatttctttaatgcatcctttgttaccttctgcagaatgccttgtttaaggtagacgtagtttacttattgaatgaatgataaagaatgaataaacctttcctttaagaaaaccctgtcactgatgtttggagtttagggaaaagatttgttggcagtggtgtggatatggaagtacaagttttaagcagataatttataggaattaaatgtacatattgctgaaagaaaaatacttttattatgcaaactaatttctgaatgcacaaatatttctttaatactatcaatatattttcacatattatcgaaacagtctattaatagtagaaataaaatggaaactctttttttctttcagtgcttagatgagtacgaagatgatgaagcagggcagaaagagcggaaacgagaagatgcaattacacaacagaacactattcagaatgaagctgtaaacttactagatccaggcagttcctatctgctacaggtgagtatttaaaaataccaggaagtcactatctattttaatggcaatttttcaattatgcctcttgagttgtatgtagtaatatatctcccattgcctcctttcctcctacttatgccttccttaccataagtgggttctgacatcacatgttgggctcaccgtaagcatgaacactctcttcacccttttccggcttgtgcatcctttgataggctgttctgtagggcctctgtttgctcctgctgagactcggagaactcatgtcggattgctcctccatggggactcttcctcaacttgattaggttttgacaactccaggccagactgccactccatgtgaacattcacttcatcctgcctgcgctctggcacagaataccccatgccaggctgcctcttggagggtagacattttttaccctgctagagctctatcacccttttctgagccaccctcctgtaaaggtaaacttcacattctacttgggactctggctgcccctttatgggactccctttctgaccttgcctcacaaatgaggccttaccttccctgctttgtagaaatcttcttcattctgctcaggctctgatttcttaggtcaggctgagtgagctgtgctatgtgagcagtctccttggtttgcttggacttgaattctctatgccaagcagctcttctttatgacaggttctgataccctgatctgagccactgtgttttctcacgttgctctgccctgcctaatggctttaggacttaattattcaggaaaggaaggggaaggatgagtttttccttttaaaatatttgttaatttgataaagctcttatttttcattttcttattttatcagttatatattagagaaattttattctgaagtcatcttcaacaatatatcatactaaattatacatggcaacatagatattttaagttagtcctgagggtcagttagcatgttatgccataattttactgagggctgtggctttgttgctagattatttgaataacatcagtattactttgctgtattcatctgacttgtatttgtctgatcttatttcacctatgctgttatacttgtttatacgttagaagttctgatctgccactgtacctgtaaagactgttttcatggggatttccttattgatctttataagcttgaataaagcagagcgttttatttaaacttacacaaaacagtttgtgctttgccaacattttctcagctctacatagatctttccccttccctttagtaatagaaaccatcccattgcaaggaagattgtttcagaaagagtatatttgaaatcagttgtataacagacttaaggatttgggggagatctaattacgtagtctttgaaacttttaagaccagtaccagtcttaacagttgtactttttacaagccgtttcaatgatactagtatagcagtacccccatatcaaagggagttatgttccaagacctccaatggatgcctgaaatcatagatagtactgaacgctatatatactatgcacatatttgtttttccttccttacaatttcatggatagaagatatgttcttatcataaagcttagcaacttcaggatatgatttttctttctttcgttattaagctgagaattttcacctttttacttaaagcaagcactttacagcttctctttggcatatcagaattgccagcatcactactcttgtactttggggcaattatcaagtaaaagaaaagttaattgaacacaatcactgggataccacaacagtctgataaccaaggtggctcccgagtgactaataggtagggagcatagacactgtggttacattttacaaagggatgattcaggccctgggcgagatggagcaggacagcaccaagtttcatcatgctagtcaggacaactcacaacttaaagtttataaattatgtctcaagttttctatttaatattttaatttattaattaaaatactaaaattttatcaattaaaattattaaataacaaatattaaaaattattaatctagctttattaatacccatgggttgaccatgggtaactgaaactgtagaaagtgaaagcttggataagggaaaaaggactactgtatttcttcattttttttttccctatttagtatggagtagtaattattaaagtgccaaataattatatagttgtttctttgcctggaaattgttgtggctacagaaatatagttaagacatctaaggtgacgtttatatttgtgtggaattttgttctaccatgtaagaatgtcaagcattttcctcgttaaaattatcagggacttatttcagtgaacataatgtcctctgccgtcatccattttgtcgcagtgatctcacttatatgtggaatccaaaaaagtcaaactcatagaagtagagagtagaatggtgattaccagaggctaaggtagatggagaaaggagaaacattggccaatgggtgcaaagttacagttagataggaggaataatttctgttttattgcacagtaaggtgattatagttcataataatgtatatttcaaaatagctaagagtattttaaatgttcttaccagaaagaagtgataagggcctggtgcagtggctcatgcctgtaatcccagcactctgggaggccgaagtgggtggaccacttgatgccagaagttcaagactagcctggccaacatgacaaaaccccatctcttctaaaaatacaacaattagctgagcatggtggtgttcacctgtaatcccagctactcaggaggctgaggcacaaaaattacttgaaccttggaggcggatgttgcagtcagctgagatcacaccactgcattccagcctgggtgacagcgagactgtgtctcaaaaaaagaaacaaaaaaaaaaagaagtgatgagtatttgaggtaattctgtataggttgttctttgcattgctataaagagacacctgagattggataatttataagaaaaataggttaaattgtctcacacttctacaggctacacaagcatggcatcaacatgtgctcagcttcttatgaggccctcagggagctactcatggaggaaagcaaagcggaagcaggcacatcacatgataggagcaggagcgagagagagagcgggggcaggtcccatactcttaaccagatctcattggtgctaaaccattcatgagaaatccactcccatgatccagtcacctcccaacaggccccgccttcaacactggagattacatttcaacatgagatttggaggggacatccaaaatatatcagacatatatgctaattactctaatttgatccttccataatatatacatgtattgaaataaaaatatcactttgtgccttatacatatgtctaatcattatttgtcaattaaaaataaagctaaaaaaattataagggacctttcactgcaccatataggttgatttttttttaacctaacatttctaatttaagatatgcccagttttctctttttggccaggatatagaaatcactttaaactccacctttaattgcccatttttaacatgcataagaagactcccacccctcccagtctctaatcatactggtataatctatccagtgtggggaacattttactgttaaaagttttttttgttgttgttttttgagacggagtcttgctctgccacccaggctggagtgcagtggcatgatctcagctcactgcaacctccaccttctctgttaaagcaattctcctgtctcagcctcccaagtagctgggattacaggcacttgcctccaggcccagctaattgttgtatttttagtagagacagggtttcaccacgttggccaggctggtctcccgaccttaggtgatcttcctgcgttggcctcccaaagtgctgggattacaggtgtgagccaccgtgccctgccaaaaaacaagaatcactataaaataacattcagcttcaaaatgtataatctctaataaaagaccatattcaaatccaccaataaggaataaactcgtgtcgtctgtgtgcttcaaaatcttaactattgaaatattagctatatacaagaaataagtatagcttaaattctgattatttgtatgtctcagacatgagcatggaatgactgtaatggcaaacccgcaattacttttcgtaccaacgtagtatgtgggagttctaattttatcaactgtatcaagctagcagtgtggaaaatactgtgtaaaacttactgagttatgttttaagtgactgagtgtttaaaaaaaaaacccaaacaactgtagagaaatgtagaaatctgatatttttacatgacttctggttagcatacttaactcaaaacttgtctgatactgacttttaagtcatttataattgggtcaaagtgtgaaattattgtaatgccactgcaatttagagttgctgaaaatgccctccattttacatttctgtttttgttaaaattctactctatatctctattactctaagttttaccatattacagaaaaagtctatttcaagcctcagaaatagtgtttgttgccaagttattcatacaatttcagttgatataccagtaacccacaaattagtaaatctagtaagggttgctctcatttagcaattttgctgacttcatttcagtaaaaggcaatctgggcaatcaagctgatgtggcatgttctgagatatttcaaatataaccaaaatgagacagatgtgagagaaatgatgtgtgatgttttagaactttattttggagattctggcattttttctcatgcatgtgtagtcagacatcatacgccttagtttagttcatatagggtaatattagggaatttaataaaagaagctctttgtaaaatgttaatgcaaataccgtttgtgaaactaccaggggaaaaacttttttttttttttttttttgagacagggtcttgctctgttgcacaggctggagtatagtagtgtgatctcagctcactgcaacctctgcctcttgagttcaagcagtccacccacttcagcctcccgagtagctgggactacaggcacacgccacttcacccagctaattttgtattttatgtagagataagagtttcaccatgttgcctaggctggttttgacttccagggctcaagtgatccactcccctcagcctcccaaagtgctaggattacaggtatgagccactgcacccagctggaaaaacttctgtatgaatcattatcactcatatttaataaagtatattttgagtgagtatacataagcttaatatttctttcgacattaaataaccatctaaataaataggggatctgttttacgtgtttggtacaaaagtgtagattcgtggatatctgcttaatgacaagcagataagaaactctttaaagtttgcttgccaggttttgttgttgtccttgctgtaagaacagctgatgctcagggatggttaaaatgtctttgtatcacctgtcaaggcatgacttccccagaactaagcgtgtttatggggtcaagcccacatacacagtcgctcaagtatcctgtcacctggttatttcctgcaactggttacttcccaaatggtacttttttgtaactgcagattactaaggaagttatttccctaagttgtcaatatatatttattgcatactaggtgagctggggttttgggggagaaagaaaggaattgctggtggagggttcttatttgtcagacacttacattttacttagaatataagatatatacatgaaaaattgagatacaaataaaactaagtgatataggcttctgtaatgagaatttattgacttggaataattaagacagacttactcaaattccatgcagaaaattcaattaagatttttccatatcccagttagttttctgtttgtgttagctatcaaattgaaattgaaagcctgtttggaagggactgtgctaattttactcacttatgtcattttatctctacaacaacccaataaaataggcactgttattccattttagagatcagtagacactgatagaggttaaacccatagtctcctagtctcctagctacggagtagcctgtctggttggaaacttgatccgatccctcctcttaatcatatggtttgctgtactggttccccacattgctagtcttttatcgcatcatgcagtcagtatttactcttttactctggaactggttatcttataaaggtagcttattcttttaccttaaccagatgagaacttctttaattgtaggatctctcttggcaacttaatgattaattaggaaaaaagttatcaatttttaaagacatcatttgattttgacctgttttattaaagtgaaactgcagaagtatttggagaacctagactgtcaaaagattgaacagagacatgactgcctagttatttgcaaggtaacaatttttctaccccaatggttaatgttaacttttagcaacctttttttttagtagcttagaatcagcacaatattaaaatgtactttttcacttttcatttttagctgtatatgtagtctttaaaaataggaactaattactatatgcacacggtaagttgtaagttttagaaaaattgatggcataaaaaagacaaagggagatatataaagactataaggccgggcgcagtggctcacacctgtaatcccagcactttgggaggctgaggtggacggatcacccgaggtcaggagttcgagaccaatctgaccaacatggagaaaccccgtctctactaaaaatacaaaattagccaggcgtggtggcacatgcctgtaatcccagctacttgggaggctgaggcaggagaatcacttgaacccgggaggcagaggttgcggtgagcccagatgacaccattgcactgtagcctgggcaacaagagtgaaactccttctcaaaaaaaaaaaaaaaaaaaaaaaaaaaaaaaaaaaaaaaaaaaaaaaatatatatatatatatatatatatatatatatatatatatatatatataatggtggtactttttaatgccccttgactttcaagaggatttaagctgagtggatgatgagtgatgcccccggccttgtccattttctgagtttttaaaatacttctttattaaaaacataattttaaaaaagtgattgatttggactgaaaaatcagatgtagactcctgttttgtttgaccagcagtgtgaattttttaaaacagtaattgcttcaagttggtctttttaaaattaggtattctctatcaactattttatataataagtaattgtgtacatacatactcaaactgatacataattatttttactttgcaggagccacctagaacagtttcaggcagatataaaaggtaagaatccttatgacttaaacatattgtagacatgaatgtaatgtctgtctgacattgacttaactagaactatttaaagcagctttttgaaaagtaagaaacttttctactgtgctcttaaaaataaattatattgtaagcaggagtatcatgtctgcctgaccatggcttattctgacatgccgaagtctttgaaaactcactgtgaatttgcatgggtctgatgaactttgcaaaataaatgccttgaattgctatttctcatgtatttaaacattgaaaatataagtagacccatctgtattagttagctcagagtgccataacaaaatactatagactggtgacttaacagaaattaattttctcacatttctggaggctgcatgtccaccattgtcaggttctggtgaggactctcttcctgccttataggtagccactttctcactgtgtcctcacatggcagagagaaagagggaggaagagggaaagtaagctttctgaggtcccttctttataaaggaactaatcgcatcatgagggtctcatccttgtgacctcatttaaacccaattatctcccaagggctccatctcattaagggttatggcttcaacatatgaattttgggaggacacagatcagtccgttgcaccacctgtacacaatgagtaacacttctaaccagagaatgtgtttgtgtatgtatatgtataggaagaaaatcagaattgggtacaagaagtttttcagtggaggtgtctaggatattcacttccttcttccctgttgaggccataaaggttgcagaagcatgtggtcatacttgcgctaataatcctagaatgataaatattattgagtacttactgtgtccaaattgctttacatagagttctttcaattctcatgattatcttataaggcaggaataatatttatttctcttttatagatgagagacgtgaggttaaataagtagaataatttttctggggttataaacctagtcaacagtaaattctggatttgaactctggcagcctgactctggagcccacatttttattaactatgtaagaccatctgcctagatttatacatgtaaaacacttactttcatctgtatgttggagtttaaaatatttcagctgtttcatctaaaataaaacattcattaaccaatattatataaaaattttaatttttgtcatgggctacagtatttattagcaatagaaagagatgagaaggccaagataatcagaagagtagttaagtctgaagtagtttctggcacatgagaaaacactcaatacatttactactgttaactgcttttattttcatttctgggtaattttgatgtaggtataatgaaacctgctttcgtttgccattaatagtttaaactggaaaaaatcctttttctctttccagaaataattatgaaatagccttgatgtggcctgttcccataccacattctcaaaccaaaaaatttttagcattagtttttggtttggagactaaagataaactgtggcaacttatcaagtttgttgtattgatcttatacatttagttcttatcaagtaatagtcttaaagtacgaatgacacttttcaaatttgtgttctttaattagaatcaagaggggaataattttataaatcctatcaaaagctttatttacatgtcattgtgttaaatcagaaggcaaatttattctctgtgaatttttgtgaaacttttgagaccattacttgtgatatgtccatgtgtttgtacttttcttacttgtattctcatagcctagagcatgtggtttacttttcagctttcaaagatttgcccctgtttaatattgttataaatatcttaaagtttcccatcattttttattggtttggagctccattttaatgccatctaaaaagagaaaaaaagacaaaaacttaaaaagccacaaaacctagaatctgtatatgaaattatctcttatctagtagaaatgtgttatactttatatcaacagtttgttattttcattaatctgtcagcaagttatagcaatgactagagaatagatgtttcttagtgaaggtgtctgctgactaatgggaatgaagaaaagggagaatagagtaaaagatagaaatttggcatcacatgtaagaaaatattttcagtaaacctaataacttattttttatatatatataactgaaaatagaaaatattttcagtaaaccaaataacttccaagaaattatatatattttatataaattatatattatatataaatatatataatatatactgtataagatttatatataaatatctataagttttatatataaatatctataagatttatatataaatatctataagatttatataaatatatatatataaattttatatagctagaaataactctgaaagtcattaggaggttcaaacacccagaagattcatttgaatgtatgctcttataaattatgaattaaatacttaatttttctcacaaataagaatgtacatttttagccttgagtctgttatgtgctcagtctaattatgctgtattttaaaacttgaattgactttcgtggaatgtgtcttacatattcccggttttccttataaaaatgtgtttaactgtagggaactatttggaggtgagggttatgtaatttctgaaactcaagatttagtaaagatggatcagtgttaccaatttgtgggtttttttttttcaatgtgtaattttctttttcttttttttttttttaatttttggtagagacagaatctctctatgttgcccagggtgatctcaaactcaagtgatcctcccaactctgcctcccaaagtactgagattagaggcatgagccactgtgcctggcctcaatgtgtaattttactcctcacctaatgtaacatgagtatcttcaccttttgagttctctaaataatggctagtatcaactgagtgatttctgccttttaaacgaagtgtagcataaatataccagaaatcctcactgtcactgctttggtaacccgtaatttctgtctactttatttgaataaaacatgactatgattctttttcttcagggtcagaattttcttgcaaagtcaattctgctataatgcttgctttcgaaatgcaaattggtcctaattggtacattagggaacagtttgaccctaactcaaattttacctttgcttatatacagttttgttcaccagaaatgctaggtaaatgctgaaaaccttacccagctcaaccaagctgcataggaatacacagaaggttctcaggcattcctggcaaacatctaccaggtacctcagtatgagctacagctttgcttctgaagcagaaaagtttccctggcccctttgcaggcaggaactggagtgcacaggtgctggacctagccaggcactttggtgtggcaggggcaaattccactcactcgaacccactgcattctacccctcgtgggagggggagcacaggtgagcaggtgcaagagccagggtgagcgcttttggaccctggcaggaatgaattctgtactgtccccatggcagtatctagggggatgcccactacccctgaagtcccagaagaagtgttatagttagtgctcttttagctttgccatccatggacggcttaagtgttaaacagttcagtgggtcctctgccttttcttgtgaggcagttgctctctgctagtgagagcagagggtcagtatgacagcctttagcgtttgcacccattcagtgtccaggaaaaatcaggtcacatgaacgaattgaagggtggtgaatatggaggattatattgccaatgaaaggggagctggaaaggggatagagtgggaagataatctttccctggtgcagcattgtcaagccattactctgaagtcaaactgcttctcctcttctcttcctctcctctctgtggtggcagagcctgaggtttttatgggcacaggatggggagcaggacgggccatgggtggttttggaaaaggcaacattcaagcaggaaaacagggatgcatgttctcactttgggccacagttcaaggattgagggtgggaccctcaccaggaccaccctcttctgcccagaattttcctgcctcctgtccctatcacttccatatgtgatgttacaacttccagtctaatttcagatatcttctttctcacatttcgtattaacccacaagctgcaacccttctgctgccaaccagcttctataaggaaacctcactactttttcaagataaaatgctgtatttatttatttcttagctgttgtaacctgtaaaactgtactaccactttatattaggctactgtattttataatgtgtcacagatgaagttttagaacattgtcctccaaccccattttctgtataattgcccccctccttttgtttttttgaggtggagtctcactcctgtcacccaggctggagtgcagtagcatgatcttggctcattgtatcctttacctcctgggctgaagcaacctttacctcctgagctcaagtgattctcctgccacagcctcccaagtagctgggattaaaggcacctgccaccatgcctggctaacttttgtatttttagtagaggtggggttttgccatgttggccagactggtctcaaactcctgatctcaagtagttcacccacctcagcctcccaaagtgctgggattacagtcatgagccaccatgcctggcccaccatgtttttattgagtgatttttgcataacacagtgattttagaaacacttaatattgtattatagcagaactaactctgggtagatggttcagtaaactaaatctttgccattgtttaaatgataagacttctacataacataaatgcatttaatttgagacactgtgaatactttaagccaggggtccccacccctcagggtgtggactgctacctgtctgtggcctgttaggagccagtccacacagcaggaggtgagcagtcagtgagcattactgcctgagctttgcttcctgccagatcagcaacggcattagattctcataggagcgcgcgaaccctattgtgaactgttcatgcgagggacctaggttacatgctcctttatgagaatctaatgcctgatgatctgaggtggaacagtttcatcccgaaaccatcctccctgccatccccctggtccttggaaaaattgtcttctatgaaactgttccctgttgccaaaaaggttggggatggccagttaagaactttagttctcaacctcattctcaagctctttcataagaaaccgactagaaccggttcaagtttagagatgaataatttatttagaaacatagttttcattcaagatttaagatgttgcaacacaacaatgttaactttttttcctagatggaactttatgattttttttttttttttgagtccgagttttgctcttgtcgcccaggctggagtgcattggcacaatcttggctcactgcaacctccgcctcccaggttcaagtgattctcctgcctcaggctcctgagtagctgggattacaggcatgcgcccccatgcccggttaattttgtatttttggtagagacggggtttcaccatgatcattgttttaaccagtagttcttgttttgagaaccaccaagtagacacaaacttccttggtttgttggtcaagggtcaaaaccagaaaaatcagccagattattattattattattatttttttttttttttttgagacaaggtctcactccgatgcccaggctggagtgcagtagtgtaatcatggctcactgcagccctcaattccctggctcaggtgatcctccagctttggcctcccaagtggctgtaactacaggcatgtgccaccacacccagctaatttttaaattttttgtagagacagggtttttctgtgttgcccagggtgatcctgaactcctaggctaaagagatctgcctgtcttggcctcccaaagtgctggaattacaggtgcgagccattgtacctggccagaaatcagccagattctttaacggtgggaaatccaaactaaagacgaccaaatatatctctcagtagttaaagaaagagagtcttcttgggctatatatgaccctttctaaagaaatctgttcctttcaagatctattctttctttctttttttttaaagacagagtctcactgtgtcacccaggctagagatggggtttcactgtgttggccaggctggtctcaaactcctgacctcaagtgatccatctgcctcagcctcccaaggtgctgggattacaggcgtgagccaccatgcctggcaagatctattatttctatattaggatatgttctatattttacccaatgctgtcaggcatgcaatagcagtgacctttctagttaatagatttgaaaacagtacatgaaagtcataaaatgattatttaaaataaattgggattcttgtacattttgtggactggtgaatttctgaacttttctaggtcataaatattattaatatttatataatattagtgtgtaccaggtactattcaaagtactttccatttagttaattccttgatagtcctagggagatgcttttattattattttacaaatgagtaaactgaggcacagtgaagtttaatgacttgtatgattaaacaagtaataatttgcagattgtgtcagcatatgttgcattacctcatggtagtaatgttaatttgcctagcatgggtaggaaatagatacagtgtggtagtttgattagcttatttaaactccaaatgactggatggtaccagtaactagatttttttcgaacatagggttttattttattttttcccgaaaagtaacttctagatatatggctctagatttcacaaatccactcagatctttactttgttttagctgtagtacaatgtcagaaaataacttgttctgaattatgaagtctaacaacatctagagtttcttcattataatgaaagataaaccatgttatagtatttggtgtcattttaagtgcattttgtgcatttatttggaaattaaccactaaactgatcttactgttccctgttattaagatgtaattcaaatgccataaaaattcactcttttaaggtgtacagttcagcatttttagggcattcacagtgtttactaccatcactgctgtctagttccaaaattgttctaccctgaaggaaacttcataccgttcatatccattcttcctctgcccctaggtcccccagcaaccagtaatatgttttctgtccttatagatttgtctatgttggatatttcagataaatggaatcatatagtatatggctttcttgggtttttttgtttgtttgtttgtttttaggcagagtctcactctgttgcccaggttagtgtgcagtggtgcaatctcggctcactgcaacccccgcgttgtgggttcaagtgattcttgtccctcagcctcccaagcagctgggactacaggtatgcaccaccccacccagccaatttttgtatttttagtagagatagggtttcaccatgttggccaggctgatcttgaaatcctggcctcaagtgatctggctgccttggcctcccaaagtgctgggattacaggcgtgagccactgcacctggccaagcatgtggctttttgtgtctcgtcatttgctaagcataattttttcaagatgattccatattgaagtttgcaggatatactatattatgttttaccatttggagtaacataatgttagattctttacactttttgcctatatgaaatattatacatataataggcaatacgctgtgaacattcatgtacaagtttttgtgtgacccctattcttactacacagaaatttttcatattgcttagttgaaggctttttttttaaaaaaaaaagaatgtatctgtatatacacacattatatgtcaaatattgaatagttcaaaggtgcagggtactatgcctggctgtttaggacacccatgttaagatgataatgaggaatgtataattttagctgtttctactgtatataataaactatatttggagagtgttttctggacttgtctagctctcaggtggtgaaatttgagcagccagatatatttgatctctttaggataattcactatatttaatataccagaaatgaatatgtatgatattccctaactgcaacaacttaaatttttaacgagatagattaaaaactataatatattgctataaacagttataatgcagccattaaaatgatgctatagaaaaataattacataagaaaattattacctgtttatgtaaaatggaggagagaacatattacaaaaaagtatgatacaaaaagtatatataaaatattatctgagaactattcatgtgataaactgccagaattctttgtaaaagaagataatgtttatttttctgggaggagatatatatttttcataagatttttaaaaggaatctgatccagaaggctaaacatttactaatatgttataaaatgttaatggacattatctctgggttagtggaattactgatgacactcatttgtattttctgttttctataataaatatgtatcaattttaataaagagttatgagagtttaatataatgggagttgattttgatttttagttgttggtgtatgtgcttatgtgtatgtttgtatttaaaggaagagagataaaccctacacagagcaaggagctgttacgaggagtgggagtgttggagggtgaagagaatggggcagtgaaagatactaaaaggatggaagccagttaagtagttgttggttatttgggaatttcagaatatatcctgtacttctgaatatttgatacttattctaaaagtaggatttacccttgagtcttgtatttcttctcattgctaagctttataatgtctattttagtggaaaattcctctagctataatctcttaatgctgccaatctcattctcatgatagttttagaataatagtgtaattttccccaacacaacaccccctggtgtttctacataagatgcgaaaattcccagagggggaaaacttccagtaaggggtggcatttatctttgatgatactgtttcttttcccttttctgagcattatagttcatgtctttgtagctaagagtggagggaggattctttttggatcgtattagagatttatgttaacattcctaagtaaaatgttaaaaactttttggagttaatgaacaatcttttattctgagtattttgcactgtgcatatctggctttcaaaataggttaaatggctaaatttggcaataagatcaagtaacacaattcttcacaattatgacagtattccctaaaacataatacatattgggaatgaagcactgattttgtttttcactattccttgcatttgcataatgaaggccgggtgtggtggctcatgcctgtaatcccagcactttgggaaggccgaggtgggcggatcacctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaaaaaaaaaaaaaaaaaaaaaaaaaatagcataatgatgccgtttatgtattgacaagtctaagatggaaggttttaaaaattgttaataagttaaacttttttgaaatattgttttaaacatgttcatcaagcaaatacacgattactaacggacatccatatttctggatggtttgtttgtagctgtcagcattatagtttctacctaaaaagtcatggatggatgcagaaagttggacttctttttttttgtgaaaaatgggtcctttaaaatgcttctaatggtcttctataatatggtatggctttagtgataccttcctctgttgattttctttttaccactttgctggtatttcccagtcttatttgtagttgtttctttcctgtatctcttcttcatgtattggtattactcaattttttttgtttttgtttctttttacagggtttcaccatgtcacccaggctgagtgcagtggcgtaatcgctcactgcagcctcaacctcttgggctcaagcaatcctcctaccacagcctcccaagtcccaagtgcttgggactccaggaacatgccaccatgcctgactaattttttatttttttaattttatagagacagagtctcattatgttgtccagactggtcttgaactcctggacctaagcagtcctcctgccttggccccccaaagtgctgagattacaggtgagagccactgtgctcagcctactcagctgttaatcttagactttattctcttttcgttttgtgtatttgtggtagaaatttcattcactccgatgacttcacttattatctatacataatgctgatgactccagatccagaagccaggagtttgagaccagcctggtcaacatagtgacacgtctctacaaaaaaaaaaaaaaaaaaattagccaggtatggtggcatatgcctgtagctccatacctgtataatcaacagctattaaatatctgctaagcaaactaaactaagcattttcaaaagtaaacttgtgaaacctgatggatttcagtagttgacatcagcatctacttttgctgaagtcagtagcctggacattatttatgacacttatttttttttcccatcttgcccttatccattcattcaccaagccttgttgagtttatcttctgagtatctcattgccatcacaccaatctaggacaccatcatctcttacataggtgattacaatagcctccacactggcctccctgtctccgtttagctcatctcccaatatattttataaaaatgatactgttactttctctgctttaatggcttaccattacctttaaatggagtctgaatcagtggtctccaaaggggggtgatatataagataatctgctagggtgcaggaggaaaatattggaacttttattcatatttacctttttatttgaaaaacactaaggcattaatatttaaaagctactactgtgtaatagttatttagtcattccttctttgctctatgtgtcagatggtcatttggtactaaaggtgtcctgagggaagcatgctttgttcactttctgcatgttgcacaatactataatttgaatgtccatctatgcggatttatgagttatctagtttaactattacaaaatatgtaagtctgggattagggaatttgtggagaaaatcaagtgtttaactgcaaataagatcacattgttgttcagctggtaagatatacaaaatcaaatctgttctcatgaattaagaaaaattacgctgattttgaggttttaagtgaaactttttaaaaaattctcatttttttgtaaggcatccctttctgctttgatagccattaaaaatcaaatattcaaactgatgttagaactagatctttgaatctctgtatcacacggtgttaagatcttcagaaataatgaagcatattcaatattttatttaaaatatttgtgagaacaaacttttgtaccataaataaaacaaattttagtctttttcttatgctctatttttgggatacagacgattattttatattgtcatattgtaaatcctataaaaatggtagataagtaaacatagataccaacatgggtatgtaattatgaataatatttggagatctttagtttaaattcttccataaaatagctttcagggccaggcgtggtagctcagacttctactccaagcactttgggtggctgacgcaggaagatcgcttgaggccaggacttcaggaccggcctgggcaacatagcaagacctaacttctaaaaaattaagataaattagcgggcatggtcgcacatgtagctactccagaggctgaggggaggattgcttgggcccaggaatttgaatttacagtgagctatgattgtccactgcactccagcctgggccacagagtgagaacctgtctcttaaaaaaaaaaaaaaaaaaaaaaaaaaattcaggtttcctgcttgctttttcagcctcatattttattactcttatgtttacactccatgctttagccatattggagttttctgtttctcaaatgggccacaatttataggtttttgcacattcttgtccttctttttacgtttcaaccttctctaacatagtgatacccaaagtgtagtccttgaactgtttgttgtcaatccaagacaagaaaagaacttgagaataagcatttagaaacttgaattgcattttgacttgtcatcatcacatccaagtgcatgatcagtggattactctgcgaacaggatatagagtagttcaagtgccgtggcaagttgcatgctaatcatgcccagcagggctgttacaatgtgtgatattttgaagttagtcatttgtaacccaaaaatgtgtaagaattaagtaaaatgtggctggcttatgcctgtaatcccaagaccaaggcaggaggatagcttgaagccaggagtttgagaccagcctggtcaacatagtaagacacgtctctacaaaaaaaaaaaaaaaaaaaaaagccaggtatggtggtggcatatgcctgtagtcccagctacttggtaggctaaggtggaaggatcacttgagcctaggagttttgaggtttcaaggctgcagtgagccatggtggcacctctgtacatcagcctgggtgacagtgcaagaccctatctccccccgcccccccaaaaaagcaaagcatttatttttaaaatctcgttaattttaatcacacttcttctcgtcccataaataatttaaaaatatatagtaattttaaaatgtaaaaatctttttcattctttagaattttatgttttacaagtattatttaaatcctggaagcaaaatttgtattatttataagtcagatttactgatgacaaaacaaactttactggacttttttgacaagcaaagatacacttttttgagtgcgatagcagtagtaaaccaaatgatgacaatggaagtaatttcaaagagatacagatcaaaagaatttgtactagttttcttggaaagtattatgtgtcctatgtttagtttttagccataattgatgggcgaagtgctaaaaccaaaaccaaagtgggttgtttggagatacactggctatttaaacaatataaaatgatcaaaatttaattggtagttgcaggcatgacatgtacaaaatgaattcatcaaatatgttcaaaaccaaattcattatttgaaagaatattacaaagatgaccggagcagatgttcaggatttcacatgtgatcactagtatttttggggtttctgatagtctgacttgaggttgctaacattaaaaaaaactgcatacaaatgacaagacaaaacatgtttgcttggaaatgttggatgaatctgtagtaaagaagatagttcacataccactttccagcaacaccatgatagcttgatgtgtttagggacaggacagtgatacgaagactaactctcagacaaataagatcctgcaaaggaatttttgttacaatttgatgaacacattggttttgctaacataggaagtaacaatttatttttcagcttcattgctgacatacagcttgctctgaactatataacacttgcaaagggttacagtatcaacaaatgtggtttggagttttgctttacttttataggaatatattctaattatgcaggcacagtaataagaaaaacatactgaagcttgtaccagaatgtaaatcggtgtcctgcttctttcattgagaaagtcttgctttgccagctgaactaaacagtgttcttgctatatcagctgaattcacagtatagtacactaaaagtgtgaatttattattaaacactaattcattacatttgaggtttctaaaaaattagatactgtagtttgggagttagctgatcagctgttatcagatgctagggtgtacattggtcttcaaactgaccttttcagtcaagagtatttgaattttgggatgaactcttggtgtttttgcaagacaagaaaccagtttggtccccagcttttcaaatatgtgagttagctttttgtctgatggccttattctttattttttaagtgatcttagctttccatgcaaagaaggaatgtcagttggccgggcgcagtggctcatgcctgtaatccctgcactttgggaggccggggcaggtggatcacgaggtcaggagctcaaggccagcctggccaacatggtgaaaccctgtctctactaaaaatacaaaaattagccgggcatggtggcaggcgcctgtaatcccagctactcaggaggctgaggcaggaggatcgcttgaacccaggaggcggaggttgcagtgagccagaaggcttttcaatggcagataagatcaggtgacaaaaatgaaagttggatttttgaggagaaagttaccttagctggttataaagggttctacgatatagtaacaactatcagtaaagtagatggtgatcttggtattgcacatttgaaaaggttacaatcaaataccttacaaatttgataggacacttttattttctatcacaagaaaattcataggtaagaaattcatagatgaggaatcaatttttaaaacgagaagtcactttcgatttaactgtaaatttgctggataaattattggaaatggataccagtcagtgaaggattgaaaacaaattttgaaaagcaaattttctacatttttgacaaaagtttttaaaaatgaatgtccgagcttgttgaaattgcattaaaatcactgctatttctgtcctttgagactgttttctctgattgctattaaaacaaaacacagaaatagtttagatatacattatcccttgttgagtagcattgtcctcggtccaacctagattaacaaatgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcccagttaagccttcagatgactgaagccccaaccaacatcttgattaaaaactcatgagaagccccgaatcataatcacccacctaagctgcttctaaattcctgaccaacggaaactttgagataagaattgtgtgtaagtttgggggtaatttttaatagaataatacaggaaacaagaagcaaactcatttgttacattaaaaactttaaatactgacatatgtgctgttcagagggtatgaactggtgtttaaggaattgctgttttacttacaacttttgattaagttagaattatggcataacaaaattatcaatatggtagcaattttctgtattgattgcctgtatgcatacttatagtggagaatttgccactgatgtaactcttttctttttttctatttataattttatgggtctgaatctaataaaacatttggacttgtattttgtatgacctttttaacttttatttttccagcagttcattttaattttactttttaaaagtgttggtccatgaaagattgtaattttgaagaaggaaagtggtttttcaccacacatagtctgggcgatctaggccaggcacaatgctcacatctgtaatcctagcactttgggaggccgaggtgggtggatcgcttgagcccaagagtttgagaccagcctgggcaacatggtgaaaccccgtctctgaaaaaagaaatacaaaataatttgcccggtgtggtggccacatacgtgtagtcccagctactcaggaagctgaggtgggaggatctcttgagcccaggaagccgaagccacagtgagctgtgattgcaccactgcactccagtctgggtgacaagagtgagaccccatctcaaaaaaaaaaaaaaaaaagataatctgggagatctgtcctatcgtagttctcatagtatccatcactgaccttattttactgatcatcttgctttattattagttatattcccttttaaccaaaagctctatgaagggcagagtccatgtttgtgtttgctgttacgtcttcagtatccagaacagtgttcgttacttaacacctattcagtagatattggtcgaaagaattaatggtacttttacatttttttcattgtgtgggaataatgattaacttctacagttacaaataagttgctactataaccatatgtccttggggaatgttaatttttttaagctcaatagaaaatattcttggcatttttcttgctgaatactagggattttaataaaatgtttatatttccacagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggtatggattataagttatttaagattgataaaattaatataccattagaattcttttgtttcatagcaactgagtgagaaaggaaataatattccttaatatttaatatgtgcgcttttctgccaactgttacctttagtatattaaaagcccttgtttttgaagtggttagaagtctgagctggcaaatatatactactgtgtatttattatattgtctgaatagattttcatttgtaactttacaaattacaggagtaaatctgagttaggtccatctttggtgtttgaaacaattttgtctaagaatatgcctgtttaaaagtgtctttcagtgcaagtcagatgactcttggcataaatttattaaccatagggtctcaggtttgtgccatagacattcaacccctaaaattagcaatggtgttgaatacttttgtaattgttgaaaatgtgttttgttttacttgagattattctctatattattaaagatctaatttatatatgttatgtaaagaaatttcatttttaaaacttgtttctattttataacatttatgattttttgaggtcacatttctaagctttaacaacagtttcttcttggaattattatttcatagttttatttatttttatttatttatttagttttgagacagagtttcgctcttgttgcctaagctggagtacaatggctcagtatcggctcactgcaacctccacttcccaggttcaagtgtttcttctgcctcagccttccaagtaactgggattacaggcatgcaccaccaagcccggctaattctttttttgtatttttagtagagaaggggtttcaccatgttggtcaggctggtcttgaattcctaacctcaggtgatccacccgcctcggcttcctaaagtgctggaattacaggcgtgagccactgtgcccagcctattatttcataattttaaattaaaaagtttagacaatatgtaatctaatagttttgaagatagttgcccagaaaggcttcgtgagttccacaagagtttggattgaattgctagtagttggcagcagctaagggatatggatggttgattgctctgtaggaggtttagtaagaaagaagccaagttctgggcaaggccttttgagctctgcttcccttttgcccccaaggtggctgaccaagcccagtgccctggattctaaataagatgtctttgaaaaagatgttgcattgtttaaagaaaaaaaaaattaaaaatcagtaatctattttagttccttctttttatccattatcagttaactggcagagccagaagtaaaactgaggaccattgtttttctgtttagagtttctattgggccatctcctttaaactttgtatttttaagaaaaattaattttgaattatttcaaacaagatacccattaaaaaataaggtagttcataacttatagtggtgataagctaaataagttaaatcacaggccgggcacagtggctcacgcttgtaatcccagcactttggtaggctgaggcgggcagatcacttgaggtcaggagttcgagaccagcctgggcaacatggcaaagccccatctgtactaaaaatatgaaaattacccaggcatggtggcatgcacctgtaattccagctacttgggaggctgaggcaggagaatcgcttgaacccaggaggtggaggttgcagtgagccaaggtgccattgcactccagcctgggtgacaagagtgaaacactgccatacatacatacacacacacacacacacacacacacacgaggttaaatcattgagtctattacattagttttgttaaagacttgtataaacatagctttactcaggagcatcctaatatctcctgtgcattctctgattccttttgtggtgggatctttgttccttcaccaaatgtcttaagggattcattggaaatcttcatgtatgtaagatattttaccaaattggggagatatatgccacttaggaagattataaataaacaattacttcctaattactggtttttaattgtatctaccaggaagtagtaagagaaagacaagaaaacctaagacttgtgagactgatgcaagataaagaggaaatgattggaaaactcaaagaagaaattgatttattaaatagagtaagtatttcaccatatttcaggtttggaggggttttttttggcaattggatgaaaatatataaatatgaagaaattattaattgcattattcactttgttcttttgttagtgaaataataattagtaagaggtatcattttcttccaaaaactgatttcctttgggcagttatcagtttagctcacttaattttattcttttggagatagactgatttatggatttgttctctgttttgttaaaatctgagggtgacaggcgctttgtcactaccatatgtaagggcactggcacagagttgcctcaagaaatatctaaaattggccaggcgctgtggctcacacctgtaatctcagcactttgggaggccgaggagggcggatcacgtgaagtcaggagttcgagaccagcctggccaacatggtaaaaccccgactctactaaaaatatgaaaaattagctgggcatggtggtgggcacctgtaatctcagctactcagaaggttgaggcaggagaattgcttgatcccaggaggcggaggttgcagtgagccaagattgcgctgctgcactccagcctgggcagcaagagtaagactctgtctcaaaaaaaaaaaaaaaaaaccctaaaattggtactctttattattattattattattttttgagaaggagtctctctctgttgcccaggctggagttcagtggcgcgatctcagctcactgcaacctccaccccccgggttcaagtgattcaaattgattacatcaagatttattattttaaactgcaagaataaatctataaatgtctgcttttttaacagtaaagagtctgtcttgaaataatgtttcttgtaactaaaacttatggtgaatttgttttaaccagatggttgtgtgtttgggacaaggattaatacagggaaaaaagagctggatcatatgcttttaaagctggagagcgaatacttaatttagtggctttgaattaattttagctctaaaacctttccttcaaaatgtcgtagaaaagtccaacatacaaattgatctggagctgaaaacaaaattgatccagatcaagatactccagatccccttttccgtaggcctcagttttgtcacctctccagagtgttatccccattgtacacctttaaagatcagacagtggtaggagtgcatctagaacttgtacctgcaccttttgatgactaatttgacacaaggttgcaacctagggctcaataccatatatggcttgcatgggtagtttttttttttgcctcagttttagggaggggaagtggagtttgtttagctaaaaaactaacttatttatgatgattgaaaattggaagattcacaattttaaaattctgactttcggcttcctttgaaaaactgaaagatctgtaagagttggcctatacacttgttgtaagaacgaagagtcaagtaatggatgctcttttttggtggggcatattacatctaaagttgttttcagagcttgccctcatttcaaaattaattggttgtatgaattatttttaatgtgtattaagtgttttcatctctcctcaaatatttttaagtatttttaaagtgtcttttttttttcttaaggacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttg

SEQ ID NO: 36518 - DNA, 15363 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggtgaggggcgcctggcagggaggtgcgggaccccctctctggccagcctcatgcccctgcgtgcagggcagggcgctccaggtgtctgctcagggtggggactccggcgtgggggtccttgaaactttgcggagctccacttccaaaaacaatgtaaagttgtataaaatcagaggaggaggacccctcgagatgatgggaggcgggtgggtttgttcctgcacagacgccccctcaggttggcagtgtcactgctggttggaagagggggttataagggaggtgacaacccctccctcccaccagttacacccattgttccttccaccatcgactgtggggagaagcagatatgcactcaggaacggcccacgattctcaaggtcttctcttccctgccccttcccagaccccaccccgccccccaaagtgagccctcgtccctcccctgcctgcatgtgtggcaccggtggctgtgatgtggcaggagggcaccagccgggctcaggcgggtatggagctgcctctaaacggaagccggggaaggctggaggggtcccctgtttgcattctggctgccctgctgggggtttggagaagcttggaggctggactcgcggtcgccaacagatccagagccacgaaaggctgccagagcctcctccagccatctttgtccaccggcatcctcgtggtgccctccctgtgcctggcactgggtgtgcagaggcaggagtgagctcaggctcctcgtggggctgaggaggctgagaaggctgagagtgggccccgaaggccctgtggaaggagcagctccgtgctggtcccggaggacgagcaggtgtcaatccaggaagtgtgtgctgtggagggctccggggatgaagaggcatggaggtcaccaagcaccgggcatcccccgggaagggtgggcagccagatttggggtggtctggagggagatgagtccaggagggaggctggtccagatgtgaaagggccttttctgccaggccagggagttgggtctggggagcccttcatggtttgggagccgggaaggggcctggaagggggcctgaacaggttgctttgcaagctttgagagaaaaggcacagagcagggggaggcctggcagggtgggggttggtgcagacatgagcaacagtacggtgtggagggagtggttctaggcctggaggccatttgggtttggggtctctggagagacaggtacagagacagttcaggttcttcctcaggggaggtggccaggaatgctgagtgggggacccggagcagcaggccctggtgaggggagaatcagctccaacctcttcctgcacttttgcagaaggccctgcacggagtgagcaaccatgaccaagaggggacactggtacctggccgctgtctgccagacactgctgggcacctagaatacagcccggacagcagaggcccagccctggtggagctgactttcttttatttattttttatttttattttttaacagagtttcgctttgtccctgaagctgaagtactgtggtgtgatctcggctcactgcaacctccacctcccaggttcaagcgattctcctgcctcagcctcctgagtagctgggattacaggcacgcaccaccacacccggctaatttttgtatttttagtagagacggggtttcgccatgttggccaggctggtcttgaacgcctgacctcaggtgattcacccacctcggcctccgaaagtgctggtgctgggattgtaggcgtgggccactgcgcccacttctttttttttttttttgagacagagttttgttctatcccctaggctggagtgcagtggcgcaatctcggctcactgcaacctctgcctcccaggttcaagctattctcctgcttcagccttccaagtagctgggattacagacgcccgccatcacactcagctaatttttgtatttttagtagagacggggtttcgccatattggccaggctggtctcgaactcctgggctcgagtcacaggtgtgagccaccatgcccggccaagtggtggacctgactttctagtggtaggaagccatcaataaacaatagtcctaggaaactgagcaaatgacacggtttgttggaggccatagtgagtactatgggaacagaaaaagggcagctgggtggcagggatgggcctgtgtgtgcacagagagaagtcagaggtgatggaggcagggcctggtatgacctcaacagacccagccccaaagaccagagacttgggcttcactctcactcctccccttgactcgctgtgtgaccctgggcctgtgttttcccatttgtcaaatgggagtgagggctgcccctggcagtggggtccacctatgcttagtggaccccggagggactctggccagtccaggctcacattgtcctctgtgtcccgggtctccatgtgcagcttcctggtggaaatgattgttttcaaaagtgtgaaaactattgtgctcaagatcaccggggggctgggcacagtggctcacacctgtaatcccagcactttgggatgccaaggcgggtagatcacatgaggtcaggagttcaagaccagcctggcacgtggcgaaaccccgtctccactaaaaatacaaaaaaattatctgagtatggtggcaggtgcctgtaatcccagctactcatgaggctgaggcaggagaatcgcttgaacctgggaggcggaggttgcagtgagctgagattgcaccattgcactccagcctgggcaacaagagcagaactctgtctcaaacaaacaaacaagcaaaacaaaactgaagatcacaagggttcccaaagtgctaaggaaaatgtgagtaaaacccaggggactggcaggctgaggatgaagagaaaagaggggtaggggaaggcccaagcgggtgaccaagcgtcccccaccagggctgcctcccaggcagtccttcgtggggctgagggcttctctgtcaaagtctgtgtgagggctcagtgagatgaacatcaggccatcccagagctggcctcaggtcagtatggcctcccccagtggggttcattacccactgccagccccactgttgccctcaccccggctagtgcacgtgcgcgcgtgctagaccccccagagggactcaggttctcactgagcactgtgtattcctcagctcagtcctgccactctgcatgaggggccgtttggcaggtgaggaatgtgagaccgaggctcgccctaaagccagcacattctccagaatgttagggacttcaggggtgttccttcttgctcattaaaaatgttcccccaggctgggtgcagtggcttacccatgtaatcccagcactttgggaagctgaggcaggaggatcacctgagcccaggaatttgagaccagcttgggcaacatggcaaaatcttgtctctagaaaaaatataaaaattagctgggcatggtagcatgtgcctgtagtcccagctactcaggaggctaaggtaggggggtcatccgagcctgggaggttgaggctgcagtgatctgtgattgtgtcactgcactccagcctgggtgacagagtgagaccctgcctcacaaaaaaagaaaaaaaaatgttctcccaccccaaatgtctggaaccagagggatggttagagaaggcacagttcaggggtacaggggaaccagaccctgaattagacagcacagtagttcccccttatccacggaggatatgttccaagactgccagtggatgcctgaaaccacgggttaaaccaaaccctatatatatactgtttcttccatctgataaccaagactgctgtccgggcacagtggcttacgcctgtaatcccagcactttgggaggccgaagtgggcagtcacttgaggtcaggagttcgagaccagcctggccaacacggtgaaaacccatctctactaaaaacacaaaaattagccgggcatgatggtgggcgcctgtaatcccagccacccgggaggctgaggcaggagaatgacttgaacccgggaggcagacgttgcagtgagtcgagatcgcaccactgcactccagcctgggtgacagagtgagactctgtctcaaaaaataaataaataaataaaaagtggccaaaggacactaaggagcatgacaacaaaatgcagcatggattccgggatggaatccaggaatggaaaaagggcagcagtgggaaaactggtgaaatcagaataaagcctggagttcagtcaacagtgctctactgatgttgatttctttgttttgataaagtactgtcactaaatacgatgtttttttgttttgttttgttttgttttttaagacagagttttgctcttgttgcccaggctggagtgcaatggcacgatctcggctcactgcaacctccacctcctgggttcaagcgattctcctgcctcagcctcccaagtagctggggttacaggcatgagccaccacacctggctaattttgtattttttagtggagatggggtttctccaagttggtcaggcttggtctcaaactcccaacctcaggtgatctgcccgcctcggcctcccaaagtgttggattacaggcatgagccaccgcccccggcccaaatacgatgttaacactagatatagctggatatgtgggattctctgtactgtctttacaactctgttgtaaatctaacattctttcaaaataaaaagttaaaaaaagaaagagaccaaagtgggtcaagaaacagcatttagactgggcgcggtggctcacgcctataatcccaacactgagagaatgaggtaggaggatcacttgggcccaggagtttgagaccaggctgggcgacatagtgaaactctgtctctacaaaaataataataataataattaataataaaatttgccagtctgatggtttgtgtctgtagttaccagctactcgggaggctgagataggagaattgtttgagtccaggagatagaggctgcagtgagctatgattgcaccactgcaccccagcctgggagacagagtaagaccctttctctaaaaagaaaaaaataaaaaagaaagaaacatcatggagagtatgaacccttttttgtcaactcagtgcatccatgtgcatcatatgtgtacacataggtgtcatgtgtgtacatgttcacaaagatatggaaggatgaacactaggggtttggaatatttttatctttgcatctttgtatattgtttgatttttgttttgcaaagagtaaatataggcataacttttgtaactagaaaaaaggctttttggctgggcgtggtgggtcatgcctgtaatcccagcactttgggaggccaaggcgggcagatcacttgaagtcagaagtttgagaccagccatgaccaacctggcgaaactccgtctctactaaaaattcaaaaattagccaggcgtggtggcaggcacctgtaatcccagctacttcggaggctgaggcaggagaatcacttgaacccaggaggcagaggttgtggtgagccgagatcacgccactgcactccagcctgggcaacagagtgagactccatctcaaaaaaagaaaaaagaaaaaagaaaaaaggctttttaaatcttacagtttgaaaaataaaatagaatgctcccctggccctgaaccttcctctgcctgctctggtctccctggtgaatcaacaccttgtaaagtcagtgagttgttcctcctaagactgagctttggggactgtcagtggaactctgggggtggagtgaagagaagcctcaacaacccccaccaagcccgactcacaccacccccgacatcctccccagagcaagagcccaggcaggcacacgcagggggactgggaactcggtgttcgtgtctttatttggagactgggagacagattacagtttaatgagaggaacgacgactcaagtgatccgatgggaagggtgagtttcctggcccttagggagcgacagtgccctggacaggaggtctttgagtgggagtggacactctagaggcctccccagctccaggctgtgcacctcttgagggtgggcaggcttgggagtctgtgtcctcattgtctcctgtctacccttggccacaggcatctctgggaagagccagatcctgtttgctctcgtcttcaccaccaggtacctggacctgttcaccaacttcatctccatctacaacacagtaatgaaggtgaggggctgggtgatgatggttgggggaagccaccaagcccccacaaactgtgaggtagcctgcttggaaactcattctgtggagccaggccgacctgggtttgaatcctgactttgctgcttagtggctgcaagacctcatcttgggcctctttgtatgtcagtgtcctcgtgcaaaaatgaggacagggctgggcactgtggctcatgcctgtaatcccagcaatttgggaggccgagtcgggcggatggagaccatcctggctaacaaggtgaaaccctgtctctactaaaaatacaaaaaattagccgggcgtggtggctcatgcctgcagtcccagctactcaggaggctgaggcaggagagttgcttgaacttgggaggcggaggttgcagtgagccgagatcgcgccactgcactccaccctgggtgacagagtgagactctgtctcaaaaaaaaaaaaaaaaaaaaaaaaaagacagtaccattacttagctcagagggtttggttgggaacattaaatgagataataaatgtaaatgtaaaaaaccctgccatatattaaacattcaataaagggtcacacctgtaatcccagcactttgggaggccaaggcgagaggaccgcttgagctcaggagtctgagaccagcctgggcaatgcagtgagactccgcctctacataaaatttaagaaatttagctgggcgtagtggtgctcatctgtggtcccagctactcaggaggctgaggtgggacaatcacctgatcttggtagatcaaggctgcagtgagccatgatcatgccactgtactccagtctgggcaacagagtgagatcccgtctcaagaaaaaaaaaattatttaggtgatagagaaggattagagagctacttcagggagtgtggtcagggcatcttcaaagagatgacatgtaagctgacagcttagtgacaacaaggaaccagccatgtaaagatcaaaggacacaccttctttctgtttttttaagacggagtctcactgttttctgttgcccaggctggagtgcagcagcgcaatctcagctcactgcagcctccacctcctggtttcaagccgggagcttgccttgtgcctcagcctcccaagtagctgggactacaggcatgtgccaccatgtccagctaatttttgtatttttaggagagacagggtttctccatgttggccaggctggtctcacgctcctgacctcaagtggtccacccacctcgacctcccaaagtgctgggattatgggtgtgagccaccatgcccagccaagatgtagattttagttggacacattatctaataggaatcttatttcttgtgcagtggtgcgatcatggctcactgcctcaacttcccgggctgaaggggtcctcccacctcagactcctgagtagctgggactacaggcacgcaccaccatgcctggctaatttttttgtatttttaatagagacaagatttcaccatgttgcccaggctggtctcaaacccctgggctcaagtgatctgcctgtgtcagtctcccgaagttctggaattaccatgatcagctaggagtcttttttttttttgagacggagtctcgctctgtcgcccaggctggagtgcagtggggcaatctcggctcactgcaagctccgcctcccgggttcacgccattctcctgcctcagcctcccgagtagctgggactacaggcgcctgccactgcgcccagctaagttttgtatttttagtagagacagggtttcaccttattagccaggatggtctcgatctcctgaccttgttatctgcccgcctcggcctcccgaagtgctgggattacaggtgtgagccattgcgcccggccaggagtcttcttttttgttgttgttgaaatggagtcttgcactgtggctcaggctggggtgcagtggtgcaatctcggctcactgcaacctctgcctcctggattcaagcaattctcctacctcagcctccagagtagctgggattacaggcacccaccaccacgcccggctactttttgtattttttgatagagacggggtttcactatgttggccaggctggtctcaaactcctgacctcgtgatctgcccaccttggccccccaaagtgttggaattacaggcgtgagccaccacacctggcccccccttttttttttttttttgagacagagtggagtgcagtggcacgatcttggctcactgcagtctctgctcccgggttcaagttatttatttatttattgtttagacagaatctagctctgtcgcccagggtggagtgcagtggcgcgatctcggctcattgcaacctccacctcccaagttcaagagattctgcctcagcctcccgagtagctgggattacagatgtgtgccaccatgcctggctaacttttttttttttttttttgtatttttaataaagacggggtttcaccatgttagccaggatggtctcctgacctcgtgatctgcccacctcggcctcccaaagtgttgggattacaggcattagccaccatgcccagtcttttttattttgagacagtctccctctgttgcccaggctggagtgcagtggtgtgatctcggctcattgcaacctccgcctcccaggttcaagcgaattctcctgcctcagcctcctgagtagctgggattacaggtgcacaccaccatgcctggctaatttttgtatttttagtagagacggggtttcactatgttggccgggctggtctcgaactcctgacctcgtgatccaccctcctcggcctcccaaagtgctgggattacaggcgagagccaccgtgcctggcctaggaatcttatttctaaggaacaagggttccatgggggaattctatcttgcagggctattgagaagatcacatgagataacatacagcacctagaaaatatttaactaaagtgagttgtccttttcttccatatcagagacatccctttgggatttcaggcatgttgttactagttggtagagtggaggttgctgttacttgtgaggtgttgaactcattcagatttagtgaatgtgaatctgaggactggaaatcaccgtctacttaagttcacacatgtatcaaacatcacctgctagttcatttctcagcccaagtcagccttgggcattcctggcagagacagcagactcagcccttgccatagctgaatgaggtctaggaagctcaaagaggctagtttctacatttatgaaatgaaaaagtgaccacctcattcactcattccagcatttgttttgtgccagggactgagttaggagctggggattaggaggtggaccttgccacggagtcctctcttagaggggagatggacttgtacctagacatttacagagcatgtgatcacgggctaaaatgagtatgttcacatggagctatggcgacagaatgtgtgcctcattgtagtgaaaaaaagactgcttcgaggaaataactccaaataggagtacaaataggagtgctctaggccagtgtggtcctgctccggcagtatcagcgtcacttgggaaacttgttagaaatacaaacttttaaggctgggctcggtggctcatgcctataatcccagcactttgggaggccgaggcgggcggatcacctgaggtgaggagttcgagacaagcctgaccaacatggtgaaactaaaaatataaaaattagccgggcatggtggtgcacgcctgtaatcccagctactcaggaggctgaggcaggagaatcacttgaatccaggaggcggaggttgcagtgagacaagactgcaccactgcactccagcctgggcgacagagcgagactccatctcaaaaaaaaaaaaaaaaaggaagaacaaactttcaggcccatccagacctatgaaatcaaaagctcttggggcaagggaagagacagcatctgtgattttttttttttttttttttttttttttttgagacagagtctcactcttatcccccaggctggagtacaatggcatgatctcggctcactgcaacctctgcctcccgggttcaagcgattctcctgcctcagcctcccaggtagctgggattacaggcgcccgcatgcatgcctggctagtttttttatttttagtagaaacagggtttcaccatgttggccaggctggtctcaaactcttgacctcaggtgatctgcccaccttggcctcccaaggtgctgggattacaggtgtgagcctccacacccaggcagcatctgtgttttgatgcacactcatttgagaagtgctggcctggaaggttggaggccatatcaaaatgaaatcattatatgccagaggacagctactgtgattaggagagcttttctgaaggagcaatggtcagttagttcaagggatgttagcaggccataagtagtcccagcttctagggaggctggagcaggaggatcactcgaccccagggtttgaggccagactgggcaacatttaaaaaaaaaaaggctagtccttgtggaagaatgctcagaagtcactgatgcatatccaggaaattgttttaaaattgtttcaagagccctggaatgcctctggtaaatcccctgaaatagaccaatcctgtttcacctaatgctccacaaatgaaggggacgacaagggcacctttgttcatggcagcactgtcagtcccagtatagaagcatggagttatttaatgaaagggtcactgatttcaaattctaggcaactggacccaagataaattgcaaacacatttaacctcttcatgttacattatggcagaacactgacccttaggtttggtaggctaggagcgtagtaaataggccgggaaatgacttcatagattcgattcccatgtctctctccccttttaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggaggtaagggaatggactgagtaccagttctcaaagggaaatatgctccctgcatccttccctccagaccctgggcttgccttctgcttacaactgtgaccattactcatgtatctttcagttataagttgagaagaaattgacaagctatttacaatgctttagttggaaatgagcacatctcaatagtcatgatgcccataaaccaagcaggcatcacagccctacttctggctgttgagacgttctgttcaaccgattagcagatccctgtatccctgtagcacagtccaggcccagaaatttcaactcagtaagtttggactgtggcccatgaatctgcaggcaacaagcatcatgggagattctgatgctggtgtttatggacatgactaattttttattatttttttgagatggagtctcactctgttgcccaggctggagtgcagtggcaggatctcagctcactgcaacctctgcctcctgggttcaggtgattctcctgtctcagcttcccaagtaactgggattataggcacgagccaccacactcagctaatttttgtatttttagttgagacggggtttcaccatgttggccaggctggtctccaactcctgacctcaagtgatccacccacctcggcctcccaaagttctcggattataggtgtgagcctggcaacatgactagattttaagaaactgtggcttcaattatgattttatactatgaaactatcatttaagttatttttggccgggcacggtggctcatgaggtcaggagatcgagaccatcctggctaacacagtgaaaccctgtctctactgaaaaatagaaaaaaaaaaattagccgagcgtggtggcaggcgcctgtagtctcagctactcgggaggctgagacaggagaatggagtgaacccaggaggtggagcttgcagtgagccgagatcgcaccactgcactccagcctgggagacagagcgagactccatctcaaaaaaataaataaaaaagttatttttggctgggtgtagtggcacatgcctgtatgtagtcccagctactaaggaaggtgagatggaaagatcacttgagcccaggagtttgagactgcagcaagctatgatcatgccactgcactccagcctgggtgacaacagcaagaccctatcttaaaaaaaaaaaaattaaaagtagttttctatataaatgctcacgctacactgtgaaaaaagcagtgtactgtataatctttcaaaaattagaaaaaaaaacccttatatttacctagagatggtaggttaaactgattaaaatattataatttttattgagaactttttccctccttactgtaccttctccagcaagctattgttttagtaattatgttcttttaagatgggcctcttcttggtcttgctcagtctctggttgctttctctttggctcagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaacatgcaggccaataggttatgtgtactatgcaagacagctgtgagatgacatttgacagaatacttggttagtagtgaaaaacattccagaacttattacaagccccaaggcaaccaccagcttggtgtgatggacaaaaagcctagtggggtcaaaatctataaacctggagatgagtcaaccaagaccagttcacatagggcaggggtgtccaaccttttggctgccctggcccacactgaagaattgtcgtgggccacacataaaatacactgatagcttatgagcaaaaacaaacaaaaagacacttcatatgttttaagaaagtttacaaattcgtgttgggccacaaagccatcctgagccgcgggttggacaagcttgacctagcgcctcgtaggccagggtaaggggcttgcactacattctgattgccaagggcaggtattgggtcattaaaaaacccaatccactagctgctatgtagggtagaaagcagtccaagtacagtgactagctatggggcagttgcagttgatcaggaaaaaggctctaggtagaaagacatgtggacacaagttctaggacttgagaaggactgctgatttgattgtatgagatgtacaatagacaatttgaggccaatcgctaagtttacagctggggggaagggtgccagtaaccaagtcggggatcagtaggtccatagtcaaccggagatggactccccctttgctttaacaatcgaacatatactgtgagccggccattaagagatgataccaagattatgcatcaagttataaagcagtcctttcatcagatggtaaattcttatttcatctccattttcttccagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 36519 - DNA, 623596 bp, Homo sapiens
ctttcaaagccaatttgaataaacaactcttccctctcaaatgggcaagagtaactcttcagcaccatggagaggtccgggcagcgtgttacaacgtgggactgtgaccagggcaagcactctgacagtgtaagttttacaaatgtctaccatctattttaggtgtatcatatttttacaaatgaagagagaaaacttcaaagtcgaactaagtaactttaaatttaagctgatggccttcattacatttttaaattcagaattaagcatttaaggtatattggaatgttcatttgaaaaaaatactttctcattgcatagttagtatgtggatatttggtgctttgaattttgagaatctaagtttgagtgttcttttttgtagtgcaccaaaactaattgcattgcagtggactttggaaatagcattttaatatacacatgtaaatagttccaaatgtacaatctgttgccctttgtatgcacaagactctctttggaaagtagttcctgatttgtacagtttgggaagatcagtgttaaactttttcaatttagattatactttcagttaccaaaagaacaaatgtctaggtattctaatgtcaatacatgggagatatttgatgacttaaaaaatctcaaatttattggtatgaaatgtatagagtggcagcttattataagtagaaataacagacaattttataaaattatatatgggctattgaaatagtacttttagcattattgaaaataattagtttcaaaatgttcaatttaaatcttcaaaccagaaataaaaaaaatggtttcttcaaaaacatcttttaactccatcttttagactatcaaatttgtagttctatgatattattatatgacacaaccaacgaagaaataatactttgaattactacccagaatgaccccaacagatattttgattagctattcaaatttttttctaagagaacatattgtcattaaaaagtaactttaacaaatcatgattcttttctcaggccaattaaacttagtttggaacatttatttatgcagaatcatttattttaaagcctaataaaatatatttttatataattgtattataaaatttatttcctttagtagttttcttcatatttaaaaaccagtagtaaatgcaatttactcagcttgacctccaattcaaatataatggattctttctgttatggataatttccaagtgaattactgttgcttcttaactcttcagtaatttggcatttgattttgggataaatggtacttacattttgacagtgtatgaagtgcataattttagaggatgtaacaattttatataaaggagaccttagtatacatttttgtcatctttgctcaatagatccactgataatttccataattgatgtcagtatttaaaaggcctcagtttttgaaaagaatgaaaggtagatttatgatttcagtttttttaagtttcatttcccaaaattttattattctgctttggtttaataggtaagtaggacttttcacacaccattgcatgtacctctgtgattttaaacttaaattgttcccttatggcaaactgtatccatttgcagcccctgatgaactttgaacaaatcattctggtttattaaattgtacattctaatccagaagaatccaagactcatgtcataaaacgcatctgcttgctgtgaaatggtgtcagattttattctgattcagaaatttatttgatctttgtctctgtctctctgaaggatgtgactcatttgtgatattgtcagaagtgtaacttttatatttgctgctttttttccaaacattttagtgatatatttataactattatccagcacacacatttttctgtagttgagatattgttgtctatgtatttatttaagcagaaattgttgctgtatgacaaactacaagcacatgtttgcttctgttttgatagcctttcaatcattattgaaacagtcacctgaacagtagaaaaatgttcagagctaaactgttagatattcacatttctttttctttctttcttttcttttttaaataacattctggtggtagcagatgtatgtgaacaatcttaaatttagttgagtgacattttgcttttcttgccaatgtaaaaatatgctcccagatctctttactgtggtccacccacccttgcaagggatttataacctttggctacaaagaatgtaggggcatatttatttatgaaagccaccctagttaggatgctttgcagggtggctgaatatagaggcagctaattggcgggtgtggtttttactgctgattttaacccttttggcactaagaaagattagttcatcttggaaatagttcttacatccaaggtattcagtctcatctctgttgcatcagtctccatcacatattcctgtagaagcaactcccctagctacagtcccaacaggagaagttccagtagggaagagcctgaaactgaaatgtgttgcaagaaggtcctaaatggtagcttcttagagggacatagggatccttggggttatttcagtgagcaggatgctgattgattccaaatgggttctaggcttgtttagtatgtctctaacactacaaggggcacagtggacattagaggctcaagagaggtaccctagcatcccagagaatcactatagattgatgattcatcataaaactttctatcaagtgatttttgtcctcagttactacattttactgttattcctttctctgtcccaattttatttgcaaggtacattcctactttgtattacatgatggacctaactaggtatgacctgactgatttgagatttacattaaatattactagaaatgatggagtaatcttaccttttccagagaatagaaaagagcttagggacttttcatgcaagatatacacattgctgaaagtccaggaatattatccaaatagaaatgtctggatatgatgcttttctcactttgactaatttttcaaattccagtccctctaaatggattttactctcccccataagtaaacttaagttgcagcatgtaaagaacaagtacacatccaggcagccagtcctagggacgaagtcagcccacttccatcttgcctaatttgtcctgtaattctgactctcatcttggatttttcacaccatctcatctacacttttggagttgactcactacatcacacagtgcctgattccattaataagacccatcttgatgcaatacacattttgaatccaacattctggattgacctcagtagcatgcttctctggaatgctgttttagtgctcgatctctgactcctgtgcaccacaatggcaggaaaaaaaaaccccacttctccaccggtttcattttgtgtgctttgaaactgatggaactgtactgtgtagaatacaatgttggtatagaaagcatgtacattgattacccatgatatagtaaatatctatttttaaaagcagtcaaagacagactcagcctaatgatgtgacagtagatataaaagaatataaagcttcagtgccttagtgcaattcatacaaatttgcttatgtttcatttttgttaagattcctggaaatataaatacaagcattgtatctggactttagtatggcttggaagaattttttctgatgtcttggtggagaagataaagacctgtgaatggaataataatttggagctagaaaccaatttactgacccctgggcaagggaatttctatcagaatatgtgactagtaagggacctcaacactgagcaatcagtggaagatttatggagaaattaaaaaataatatttacaggctggtgcagtggctcacgactgtaaccccagcactttgggaggctgaggtgggtggatcacctgaggtcaggagttcgagaccagcctgggcaaagtgatgaaaccctgtctactaaaaatacaaaaattagtggggcatggtggcaggtgcctgtaatcccagctacagactgaagcaggcgaatcacttgaacccactgggtggaggttgcaatgagtcgagatcataccattgcactccagcctggacaacgagcaaaactccgtctcaaaagaaaaaaaaaaaaggatggagctatttttcaacggtataggaataaagcattgagcttctcatcaccagaaagatgagtcacactggatgacccacataaaagatgctatagaaggggactccctaatggtgtgtgtgcatgtgtagcagaagggctatgtgatctctaaggtcttttccaacttagacatggataagggtcatcagtgcagtgtcatctcatttaaaaaagaaagcaataatttcttcattcaacaaatatgtactgggtacatactcttgtgattacaagaactgagatgattaatcctccctgagctccttgagaaaccacccacttgaaaaggagtaaggggaaaactgggaaataaaaccccaggtaggttttattttaaacctcaggagttgggaaaaacccaggagggagagtaagatgcatcacttggatctatttgagaagggaaaactaggttaaaggagaaaaaagcagaactggagttataatttatcttttcattatctctagcatagagatactacaatgcataaaaaagaaatgaaaaatttagaattcattgatcactaatcaattctatgattctatttaggactgtcaaatctctaatgagcttttttgctctttcgcctgtatcctttcaatctgtatagctatagctgcatcatatacctttaaagattctgttccaattgtcatctattcttttataaattgggagaaatcctgaagctgtagaccatcaattcaaggggtcaatatcaagtcagcatagatactggccctgctctgaatttgaatctttgcttgattaatttatcatacatggtgaatctaggctatgctgtaacgaagggatccccaaaagtataatagctcacaaacagcagtttttttcctgtttaggcatcagtactgaaaggggaagcaatacagtggggtgacccttcttcatatagtcattcagagaacccaggatggtgggagctatgccatcttcaacacatggctctcaagaccaccttacagttgtctcccttctagcaaaatagaaaggaaaaagggcacatgtgggaggttctagtgggcccattctgaaagaggcacacatcactcaactcacattcttttgactgaacccagtcacatgctgatatggtttggctgtgtccccacccaaatctcaccttgaattgtagctcccataatccccatgtgtcatgagaggacccaatggagggtaattgaatcatgggagcaggtttttcctgtgctgttctcatgatagtgagcaagtctcatgagatctgatggttttataaagggcagttcccctgcacacacgctcttgcctgctgccatgtaaggtgtgcctttgctcctccttcaccttctgccatgattgtgaggcctccccagccatgtgaaactgtgagttcatgaaacctctttttctttataaattacccagtctcggatatttcttcatagcagtatgaaaatggactaatacacatgccatacctaactgcaagggaggctgagaaatatcctacaggttacatagaaataagaaaataaaatagattttagagcacttagtactttctgccatacctggacttctgttctactgtgggaagacttcttcctccaaacccacagttcctgttgctgtaaacctggtatagcctgctagatctgcttgatgttaattttactgcagccttgaccattgctaatttcagtcttcaggttgcaaactatagaacttgaccctaggtaatttaagctgaaaaataatttattagaaacacaacagataactcactaaattgacaggaaggctagagaatcaggctcagaaaaagggaactaaaggaagttggttggccagaaacccatggaaaggcacacacaagaggcaacattattggaatgctgttggcctcagtacattggatgcaatggttacacagttcaaaaatacccctcacttttctgagacacttcttccagatccaaagtcctgaactgggccatgccattgactggtttagatcatgcattcaggcctgattgctagaattcagggaagggaatttcttctataatggggggtagagtcctggtgcttactgtaatatgcatagcagtgtattctgtaattatgagagggtctcagataaactaaaaaagaaaagccaaactccagtgtccctgatgttgtaaaatgcccctgatgtcacattagatcttctgatgaccatggtgattcttgttgactccagttggccacatgcctagactatgctttattgctatgcctagactatgccttgttgcccctcctggaatgtgtgtttccaccactttcactggtttattatactagcctgcctagtaatctctatgaatctttctctggccctttttgatgctagctgagcttttcaggtcctttcctagaacacttggccttgtttggagaatttaatctagacctgggacctatgtgataagttgcagggccatcgctcagacatttgactcatctcctggagggttttctcatctgtaaaatgaataagtcggctcaattcccgttagtctcaaagggacacgaaagcttaacaagatcgtgcttcgagatatttggaacacagggtggcattatcacattattattttcacaagctgttaacctgaagggggaaaataaagagtggaaatttaatgccagagaggttttggcactttgtcaattcaacattagctttgagggcttttggaattttgcctgaaattttcaacaccaagtggctaaaagctgtgtttttctgggcttgtgatattcctgtccccagggatggcattaagcacttgcgaaggatgaactgtgccaggcctatcttccagtgtcccacaaacagacaaaaaagcaatgcacactctaaattgctgtgcaaacccacattttctacttggaacagcacctctgacttgtgccagtagaaaagggatgatgggaagggagtaatccacgattgcatgtgttaaatacattccctatgtgacatgtggggcaatcgtggctgtggaggcttctgtttgggtgcttggatggaccctactgaagatcacaggacctttataggtctttcacaatctcccacatcagtcttttttgaaagagagctattgcttatgcaaaagtcgcccttgccaactaaaccaaagactgggctaattagaagctaggaaaaagaaatacatcctcttggaacttcattttgggattttggaaggaagagaaaggcaggaagacctgctagaatctggggaaacatttattcattccctgtaattaatgtttaagctatgtgatcataattacaccgaaatattctaagtggtttactttatttggacaagaattattttcaaatacataggattccacatatgcgcctaaaacacatatgcacatatatttaaaaaataatatgctttatatattaaaagatgataaattttcagtgtcaagagctaaaaagtatagttttgaatgaatgtgcttacacttcttaatgtatgtacattttgtattttcatgaagacctacaaatctgtgctgtgtcagtggaagaagggagctatttacattttagagcaaagtacagtgatcactaatttatcaaaaactgacaggaaatgaggcttctgtataaatgaaatctatcaataatggacggttacttttttttcagtcaacacattttgaatggcattgtttctaaactacattgtaatattctctgtctcattttatagcaatgcctattcatttatcgttgtaatgtgtatattcattttagaaaatatgaaatgttaaaaaatatatctcaccattaatccaacaaagacccctattgttaacatttcagtgaatttccttggagattccgaaatgtgtatacactaggtattagtatgaatatatataaatatagctcttaaacatattttcaacatttttcactgtgcttttaaaaacttaatattttaatttctgtgtcattaaaatttcttaaagttttatggtacagtgtgaatgagtaatatgaaatcacatagacatataatttattgaactatgccactatagttatcaatgtcaacattgagtgttcatatattttcatatttttgtttccttacaagagattactgtaagtataataaaaatttatataacatttttaaggatattgatatatattgttacatccctagaactgttgtgctagttctgttaatttaatagattgaaagtggcctgtgtttaaaacctgaatttcttttttagttgttgaggcttaacattttcacattttgtggccatgttgacttattctgtgaattgtctattgtttcactgagattttatgtgttaaatattacgtatatattattaagcttttgcattcgtatatgtgagatatattttcctagattgcatatttcaatctttagaattttaaatttttttttggaaataaaacctacttagtatcccattcacctatatatttttgtgttttttgaaaactggtttcaactttatcatttgtcttaagttcattgaaattttggtgtatggcataatgagaaataatagtcttattttattccaagtagttaaccctttacctgagcaccatttactgagtcctttgttctctactagtttgtagtagttcgtagcagagaacaaaggactcagtaaatggtgctcaggaatctttaccatatgttaaaaataaatccattagaatctgtttctgaactaccttcatgaatagacatggtttcacatgtctattctagtacctatattttactgtcttaaatattacatttatatgatgaattttaatatctagcagggaattctccacttcatatattttcatgttcttggatggtcagactcattccagataaactctacaattgtatagttaagaaattatttagagactttaatagcaattgcatcaaatctgtaaactaatataagaactgatacctttgcaaatttgttcttaccatctaggaacgctgtgtagataaataaatattgataaggacctaaatatgcataagaacacgaatagatatagatatcaggaaagatttgaaatttcatatgttttatattttttattttttttgagacggagtctcactctgtcgctcaggctggaatgcagtggtatgatctcagctcactgcaacctccgcctcctgggttcaagtgattctcctgcctcagcttcccgagtagctgggattacaggcccatgccaccatgcccggctaatttttgtattctcagtagagacgaggtttcaccatgttggccaggctggtctcgaactcctgacctcaggtgatccgccgcccgccttggcctcccaaactgctgggattacaggcgtgaaccatcatgcccggcatattttttactttacttactatgattgttcctatgtacatggattatggattatttcctttttttttttttgagacggagtttcgctcttgttgctcaggctggagtgcaatggcgcgcgatcttggcgtgagccaccgcgcctggctatttccttccttttgttccacctctaattggttattactataatataggaagcgatggctttttgttgtattgatttgtatcttttcaatttattaaaatctcttaatagtacttcagaatttttttagtggattctttcgaggttgttaaccatgtaattttctcaactgcaaataatactaaattgcctcttcctttccaaaagtcttattgtattgattagaaaattcaacctaagcaaaataggttgtcttattatccatagttgatgcgatgagttatggtctgttcttgcattgtggtattgctgtttggttttaacgggtagttctttatatgttgctttttatttctattttatggtatgttgtttaagtttttacatctctgcttaaaaacgaaattcacctgtagtttgtatttctttcaagtttgaatcagggctgtgcaagcttcgtaaaatgaaaagcttcctagattttcctttggtctctaatttcatatagcatggtaattacatgttccttgaaagtttgaaaaaaattcttgataaaaccgtacagccacaatgtcttttcttataaatactttaaaataacattttcatttcttccatggttattagatattcaggttttctacaatatcataagtaaattctgctacttactttccaagatatataagtgaatatcttgagattaactatcatattattttgtttaaaatttctctctgcatactcctttattacttttaatatttataattttgttaattgaaattttataagaatcagctattgtgttaatcaattctgtattttctaattaatacactttgatattttaatgtaatatttagtttgcctgttaactttaggtgttttgttttgtttttttgagatggagtctcactctgttactcagaatggagtgcagtggtgtaatctcagctcagggcaacctctgcttcccgggttaaaacgattctcctgcctcagccttctgagtagctgggattacaggtgtacgccaccacactcggctaatttttgtatttttttttctttagtagagattgggtttcatcatgttggccaggctagtctcgaacttgtgacctcagatgatctgcttgcctcggcctcccaaagtgttgggattacaggcttgagccaccacgcctggccaactttaggtgtatttttgttgttccatttattttttcttcagtttaatgcatagttaatttatttgttttgatgaattaatattttaacaacaaagttaaggttttgaatttgttctaattcagttgtgttctcgatctaataagcagtatcctcattttctttatattgtaaagattttgtaattacatattttttcctataactcaactattatagaaacatttaaaatttttgtttaatgacaattctaaaaatgttaaatattaagacaataatttcttattttgttaaattgaagccatcaaagatggcctttacaatttttactttggggtatttgtgtagggatcgttttttagtttcatatagaaatataatcctacattctactgatacttgaaaagagtttctgatctttctttttaaggtacaaagagttcttatgttaactaattaatcaaatattcacattcttgattcctactttattttttgtttccgtgatagataacagggattccctgatagataacaaatagatagatatctatttgctaatagataacagataactgatagataagttacaaaacttattctcaacatttctgagttattttattttaactgatcatttcataagcagtatgtagctgaattttgttttaaacataaacacaagttgttttcactaatcaagagctcattttaataacataagaacaagctattattaagtttgatcttcttttgccttgtttttgttttgtgtttctcatatttcattgctttttttgtttctcatatcaattatattttattttatttattgtctcaaataaattggaatagaaacattcaatttttattctgttggtagttaattacagatgtgtaataataatacatgtatctagttttaataataaaaactaaaatttcatgttaatttatccttctgcaatattttaagtgaatattcactcattcaataaacatttgttgaggacctactccttgctgggcattgacctagcattgggagtacaatagaaaccaggatagaggcatttcctattctctttagtttctcccctatctcattattctccttttcacttctcagtttgttgtttctatatctcttttatttatatttaaaacttatctttcaagaactattttttgacatatgcattgttttgtgatcttttaacaacagttaattagatttagtgtatattttattcattgtgtttattcatgtattttttacttttattttaaattcaggggtaaatgtgcaggtttgttgtaatataggtaaattccatgtcatgggggtttggtgtataaactattttgccacccaggtaataagcgtagtacctgataatttagttttttgatgctcatcctccttcctccctccagcttcaagtaggccctggtgtctgttgttcctttctttgtgtccatgtgttctcatcatttagctcccacttataagtgagaacatgtggtatatggttgtctgttcctgtgttacttcacttaggataatggcctctagctgcatccaggttgctgcaaaagacatgatttcattctttttgtggctgtttagtattccatggtgtatatataccacattttctttatccagtctactattgacaggcatttaggttgactctgtgtttttgctgttgtgaatagcactgcgattagcatacatgagcatgtgtctttatggcagaatgatttatattcctttgagtatatacctaataataggattgttgggtagaatgataattctgcttcgagttctttgagaaatggccaaactgctttccatagtggctgaactaatgtacatttctaccagcagtgtgtaagtgttcccttttctctgcaatcttaccagcacctgttattttttgactttttaataatgatcattcagactggtatgagatggtatcttattgtggttttgatttacattgctctaatgattagtgatgcagcattttttcatatgcttgttggccacatgtatgtcttcttttgaaaagtgtctgttcatgtcctttgcccactttttaatggggttgttttctgcatgatggtttgtttaagttctttatagattctggatattagacctttgttggatgcacactttgcagatattttctcccattctgtaggttgtctgtttactctggtgatagtttcttttactgtgccgaagctctttagtttagttaggtctcatttgtcaatttttgtttttgttggaattgctcttggcatctttgtcatgaaatttttgccaggtcctatgttcagaatgatatctcctaggttatcttcccttgttttaatagttttaagttttatacttaagtctttaatccattttgaattgattcttatatatagtataaggatttttaactattgtttatactatactttttctattcttatatttatttttattttatttcactttttgagacagacaaaaaatctttatatacttgaatatcagataatgtgtttttggggcacttgtgcatgaattttagctgggctgggtataaaactgttgactcttcatgattcattgaaatattccataattattgctttattatcttttagtaatttgtgttgaagaaaattttaatgaatatatagtttttatttttatattattattggagaataaaccgcattctattttaaattactgtctagcacaagataattataatagctaaaatttataccgcattgctatatgctaagcgttcgtctaagtattttacatatgctaactcctttaagtccttttataattatagcaatcctataaaatgggaactgtaattattctcattttacaggtgaagaatctgggtcacagagatgctaagtaactttttctgactacatggagagtggcaagtgaagctaaaaggcagccagctcagcatgctggatcttaacttccatgctctgatgcctgtactattaataaacaaatatttttcaacttaaataggaaagtaaatgaaaatattaaattgttttctgtagggttcaaaacagcttcatgtatgatatcaatttcttggtatttttcttgacttctttcagaacataatatacttgcttgataaaagtagggaaaagatgagaaagagaagaagaaaagtattgatgtgctagaggtggcatatggtgtccgatttgatcttctcaataccactttgaggtatactacatgaagtaaaattgtagaatcatgtcatacgagttcaagtccagtgttattccctctgcactgtgagtctgaaggacagtctatgtgcaggctgtaaagaagaaatcaaagacaaccacactctcagctatactcctacacatgaataaagttacttttagcaatataatttttaaaaaataaataacatatttctaatttaaaacgatgcctagctagtatcccctcatgcaactgcttctaattctccattagcatacctacgaagtcacagtaaaaaatgaaaatgaatattaccattgaaatcacagatgactgataaccttttgctaggatcttagaggcatgtgcactgacaatagaatcaatgaaggtgcctgtaaccccagcactttgggaggccggggcgggcggatcatctgaggttgggagctcgagatcagcctgatcaacatggggaaacccagtctctactaaaaatacaatattagctgggcatggtggcacatgcctataatcccagctactcaggaaggctgaggcaggagaattgcttgaactttggaggcagaggttgcagtgagccgagattgcgccagcctgggcaacaagagcgaaactcggtcttgaagaaagaaagaatcaatgaaggtggacaacattgagaacacatgcttcagctcatgaatgaagcaacctcaaaatctgaactggcaaggtgaatgggaatggtctgattgtggtgagggtagtcagatttttgttgctccctccccatgctccatacaccgcaccacctttctttagtcacattaataactttcttcccctcagtcttccctatgtaagtcaatactgagctgatcaagagaaatgctggaattcattcttctttcctccctttctttaccactattccatctttcccatttacatctaatcaaccaccaagtcttgttgactttatcttcaagaatgtatcttaaatatgtaactttttctcatcagcattgccaacaccctggcctaagccaccgtcatctctcaccttcatcactaccatagcctcctacactgagttccctgcctgctctaatctaatctccacaaagcacccagtgtgaacttattaaaacttaaactgcattaatattacctacttatttcagtagcatcaaatttccctttatgtaaaatccaaattccttgccatatcctaactccaaagtcctatgtgatctggtcattttctcttcatattgcctcagccacaccagcctataagttcatcaaacacataaagctcttatttatttatttatttatttatttattgccttagaggtttgcgtatcacagtccttgtgtttggagtgttttccttcttcttcatctggcagcctctccctcatgatttgagtattaagtggcagctccttatagaagttcttcacaactaccattattctctcaaactgcatgctagtgtttttcctttatcttgtttatcataatttatcactccttaattaataattttacttgtttatattgtttgtctttccattaaaaccacaggagggcaaggaccatacctagtttctgtcaatgcgcagggcctgccaaagggttgatactacataaacatttcttgaacaaatgaatcagagaatccaccagatgctgcagccctcaagaaacaacaggagaggaaataaatggcggcatatttcaatgtggtggcacatttcaacgttcttacaagtgaagggtaagatagacggaaaatcttgggaacattcacaaatagcactgtggtcttttttatactccactagagcagaatgccagagggcaggggtaagaaaagattctgctgcacccaacgaagctacactaagcagttgcctcctaacaccaaatatggggcatgaggctatgcttgtcaaacaaactttttatctacagacctaagacgatgacattggtaatggggaactaagtaatttagaataggctttccatcgaagacaactaaaaaaaaggtggataacacataatacaacattatgcggctataagagggagtgaagaatatcttaatttactcatacaaagtgatctttgggatgtattattgaaagaacaaaataaagagtcagaaaggaatatatagtattctacttttcatgtaagaacagcaggaagggggtggtaaataagtgtctgtacttgtatgtttttgtttgccaaaaaagaaacaacaaaaggaaaacctaatggaactaatgaaaatgtttacctatatgtggacagaggaagcatagcaaagtgggcagggatgaaaataaaacctctttgaatatacctggttttaaagttttgaacttggaacaaggtaaatatattcatagaagaaaaccaaataaaaaacaaaataagggaatctctaaaaacagaaaattaatgaaaacaaatgaatctaattgtttgtgccataaccacacaaagaaaaaaattatttcaggtgactttgggacataatattctgactaccagtaaaagattttaaagaaaaacattctttaaaagaatattatgtaagggaatacagaactacaaggaaatcttaaactttactcaatagtgatattggcattactatactgtacttattttacagtgttttaatttataatttacataatgcaagtaattatcttactgttgtaaggaatcaagatttttagatatgagaaaagaaattcagtataaagctaaaacattatgtaaaatatgtaaaattctgcattattaaatataaaatagcaatataagcataaaattttatttataaaatgtatattcttagttcttttccatgaaaaagcataaaagaaaataactcaacagaaattagtgcacctagtttgtggtctccaaatactattccagtctgtaaaaaccagaattacttagaggagcggctgattccagctctcaggcaaaaaatatacaaaatacacaaggaaggttccaaagaccaatagagttatgtgaaagtacacagaggtttttctggccaaagatgagaatatttgggcataaaaaagataatgaaagcaattattggcaacagaataaatatgtaaaagcctatgtgtttataataaaattataaaaggagagaaattattggacaccactgtaacaagaagagcaacactctttaaaaatatgtgattaatatgaaaaaattaagcatatattaagtttctccagcatgaactatattttgggaaaccaaataaacctaggtaataagatcaatttctgctttacaaagttccaggcaataaatataggaaaagtgaaatgattagaaaatcacaattttgcaaccccaatgaaataatagattatgatctaagacaatcatgaatggatgaagccacaagatgaaaggttgatgggaaattataccaaggatgcatcagattgtcatcacttgaacccaattattcatcaatctcagcatcagtaagagtgtatcttcttgctgtaattcaacccaaagtacacagcatcaccacagtacatatccctgtaaaaataataaaatccaaatctaatcgagtctttgtggctaacttccactataggaaatatggcaggtgaaggatctagttaaatgacaaagaagccaactgaaaaactgaatgtgtgatattctgtgagacaattgactcgggttcttcaataaatcaatgggatgaaaaataaaattattttaaaaaaagaagaaagaggaagctactctacattaaatgacatttaaaggatgtaacaaccaaatacagtatgtgggctttgtttggcttctgactcaaacaaaccaagacaattagaaaaagtttagtattagatagtatcaaaataccattaatccttttcttagttgtattgatgacaacataggccataattattgaagaaaacttccatgttattttagagatagatattgaaattctaggggtaaaataacctgatatctggcacttattttaaaaatagttgagaaggaagaagagaaagaaaaagagacaggaggaagacaggtagagagaggagggaaggcagagaaagagatgtaaagtataagaaaatcttaataatagttaaaatctgggtaatggatacatgagagctcattgcaacattctattttgtatatttaaaatttttcagagaaataagaatgttgaatttatagcttggtgaagtaaacagagtcttggttagttggctagttaggtgagacaaatactttattcctcattataatgatatgtgttctttgtatttgccagttatttaatataaagacattaggactataatgctttaaaggggggcatgaaataactatcaagaaagggagcaattactttgctgagatctaggagaggaggggaacccagaaagtagaactcagcattcaaggtagtacatccctcataagaatgtcatgaggactgagaggttagtgattgtcaagtgcttgcagcaatgactggaatgtgcgtgctagttaaataactaaaatgatttttaatatgtaatcggtttccctactacattatccatatttcagttttgctttattttcaatttctttttaattaatatatcatcatacaatgtacaaagatttctggatattggcatcgtacttttttggttttgttttagggaatcatgggatgtatatagagtttctattctaaaagcactagtctttcttgggctgggcagatttttctcatcctgtttatagctacccccttgtattttttctggagttgattgtcaatacggggcatctttgcaatgaccatgttatctgatggtcatctcaacaccatataatgatgtccataatcaacatcactttgtgtagattaaaaataatagctgttaagcaacatttcatcagggtcacatgataaccaataattaaaacaattttttcaatttggttggctgttttaatatttgcgtacattacctatggtaaatggatgcaatagagatgctagaacaaaattctagcattatctttgaagttctttgtttgaatattcactatgtcctctaatagtaagaatggcccaagatctgcccagccatgttcccatgtggatatgggtaccaaatctgaagggaaaacatctattttcaaaaagggctggtcagcgcaaggaaaagtgtccttgaggcatttgtgaacttatacaggccaccaagtttgctccattcattcatctcaaggagcatcagcgtatagaggcacgaaggtggtatatgggtgagaaggtggtacggaggtcacaattttgtttcttgctcttgtcttcacctgctccaatctgtggcctgaagctacactgcaattctgataggtcactattaacaatgccaagtagcaatctgtcaggaagaattataaatgagccaaagagcaggtggttaatgcaaaaggaatctcagacaaataggagacataagtctttcctccatacttcctttcctctgtttattgtcctgatatcagattagctgctggagtttaaaagcctattattctcaagatgtctttcagacaatttaactcaatagttatagggcaaaaaataattctctctcggaggtggaagggaaggggaaacagagcacacacaacttctttcagataatttttttctttagaagaaaattaaagtaacataggggacttccaagaaccaaggggtccacaaattactgttagattcgtgctagaaatccaggccagatactacagggcaagatgattatggttcccagtactgtccaaagacagtaatctgtgagtaccatgtcttaggtgctatgtaactatccatcttgaatggagtgcctgtgctggacagcatggacaagttaaccactctaggactctgcttctacacaaacatgataaggaggttggattagttgctcatttggatctttggaaactgctattctagtatgatggcttcatgtgctagggcaagtggcctgcttctgaaactcaaaaatatttgttttagcaggataagaaaaatgtggattattttcatcttactatttaatagtagcagaatgtctgtgtggttccatctctgcctcaatagtaaatgacaaatactaatataatcaagttgatttggggttctcaataagctctcacaagctggaactgccaacgagatgctttaaaaatattcccttttgtatagtgaaacaactttggaaattgtaacttaagaatatgagtatttatttatagcccaccttttggctgagatttgacatgacgtttttctttcaacaaaactctgaagtggcacaccatgatttgtaattttatttggctattgtctgcatatgcagacaattgaaatgcagaaagttgaaaaattattcaaattctaccaagtgtatttacagttacttttctgtgactcagattccctccttcaaaacattttaaagtctccatatagaatcaagattggacttttcagagaagggaaaaagtaaatgaaagagaccaagtttttgtcttttctcagaggatgatgaagtagattttagagtcttaaactacattgaagggctgggttggcaataaatctctacttgcaacttgaactactgagtctccatagatgtttcagacctgtgtctgactggctcataagaattaggaatactcttcataagcatcttagagtggatcagaatcagatcattacccgaaagggaaaggtagtttactcctgagtccttacctcattacaattttttcttatcaactgacccaaatttagactttgcagatagaaatgacatgtatccgacagcatattagcctaaatgattcaatataaaggtcaaacctcacataaaagaagagtccaataaagaagtttacaacattccccagaattgctcttctcatttaatttaataatcccagcactttgggaggctgaggtggacagatcatgaggtcaggagttcgagaccagcctggccaatatggtgaaattctatctctactaaaaaaaaaaaaaaaaaaaaaaacaactagccaggcatggtggtgtgcgcctgtagtcccagctactcaggaggctgaggcaggagaatcacctgaacccgggaggtggaggttgcagtgagccgagatcacgccattgcactccagcctgggtgacagagcgagactccatctcacaaaagtcaatcaatcaatcaatcaatcaataataagatttgcccatcttaaaatattattctcagcactctctactctcttgcttccctcacattcttcctcaggctccttcattttttctttctgcctccagcagcatcctctctcatccctgcttacatatccacctatagagtccttcctcccatcaagcatggcctgcttccaggtcccatctctcaggctctgagaaatagtgctttaacttctgccagcccttctggcatttactgtatagatttctgttcatgttgcccctgccctgtgttaaaactatatatgcttatgtgttttcttctagactgtaaacttgaagacagacgtggttgatgttgacctttgtatttattgcattatattctacataatggatattccataaattttttgaattgaattcacttgcatttagtctttcttaatgtataattaataatgtacacatatatgtcaatgatacgggaaaatgaagtaaaatgaaggttaaatgtaaagaagaaacaagagtagaaacttcagaaattatcagtgttcattttttgcactaggatgcacagttaggtttcattgcctcaaaccttaatttccaataataaataatgtcattcccgagagaggaggaaagaggaaaacaaccgaaatttgaggagtcagggattatgcttgctgctctttttttttttttggaagtaaaatatgtttacttgttaaaatatttgagccgaaattatttcacatgtgaacataaaaaatagatttaagactattctccatttagcagaatttgctctgaatttcccaagtaccccagaacctatagagggagtactttcttattttaatatgtttaattgacaaataaaaattgcatatatttaaggtgtacaacatggtgatttgatatacatatatattgtgtaccaattaccagagtcaagttaattaacacattaccacccatagttaccattttgtgtatttatatgtatgtgtggtaaggacacttaaaatctgctctctcaggctgggtgtggtggctcacacctgtaattccagcattttgggaggctgaggtgggtggatcacctgaggtcaggagttcaagaccagcctggccaacatggcgaaaccccgtctctactaaagatacaaaaacttagctgggcatggtggggggatacctgtaatcccagctactcaggaggctgaggccaaattgcttgaacctgggaggtggaggtttcagtgagccgagatcgcaccattgcactccagcctgggcaacaagagtgaaactctgtctcaaaaagaaaaaaaaaaaatctgttctctcatcaaatttcaagcaaacaatacagcattattaaccatagttactatgctgtacattagatacctataatttattatcttataaactaaatatttatactctttgactaacatcttcctatttccttcactccctaggccctggcaactatcgttctactgtctacttctatgggtttgatttttttagatgttatgtataaatgagatcatgccttgtctttctgtgtctggcttatttcacttagcataatttttctgcaggttgatccattgttgttgtaagtggtatgacttccttttttaaggctgagtaatattccattgtgtgtgtgtgtgtgtgtgtgtgtgtgtgtgtgtgtgtgtacataatcaccttttctttatccatttatccattgatggactcttaggtacttccatagtgtggctgttgcgaataatgctgcagtgaacatgagagtgcagatacctctttgacacactgatttcatttgctgtagatataaacccagaagtgggattgatgggtcatatgatagttctatttttaatttttcgaggaacctccatactgttttctataatggctataccaatttacatttccactaacagttgcacttggtactttaagacaggcattgctattctcatttttcagggaggttgagtcactgcacagcctgccacagacaatagagctgggaccagaatctggactcaggagtgtgggttgccaaaggcctagctcttctaatgtgctgtactgccttcctaagcaatgatgatggtaaaatgtttttttaaaaaaaagatatgcagacacaccactgtcaaagaaagcccagttttcttttacaagtttgcttctatatttcagatgccactaatgcactgtcaatcagaaaagggcaggatttgtaagttccaatcaacttagggtcaccctgaggtctttcaacttccctgtacctagaatgatcttccccctagtagctgcgcccttatcctgtcactccatcaggtctttgctcaaatgacatctgtcagaaagacttgctctgaccatcctgtgtaaatcagcagccccatccccacccaccaagctttctggctcaacatactgtatttttcctcagagtatgcatccccatctgacacaccatgagatatttgtctatttgtgtggtgccagtcttctgctcactagaatgtaagcaagctctatgagggtagggagtttgctctgtttgttcactgatgtatcctcattgtccagagagtgcctggcacatggccacccccagtatgtatttattgaatggatgaacaaacacagaaaagaccattctacagctcacatagatgattcataattaatgctattggcagttcctcaatgactagaaaatttggaatatttttcttcccccaatttacattcctggtgtccagaagattcctgcctttgctcaccttaccacttcccaaactactccctacaacttctctcttgtttttgccataggtgacttttatcacaaatcaaccatatagacctagaattgttattaattgtgaaatttcttgcagcaaatcatacgtgtcacctacaggctccccaggatctttgtagtactacacacaattcagcacacaacttatagattaaaaagaaaaacttgtattgctgatttcttcacattaccaaacttgcctactctgatagcttatgtttggagcatttattaagggccctgtaagttagatgctgatagaataatataatacacggacactcttgtattgcctgcagagctctcagtcctagttttgcagatcagatctgcacctgaagccactcaaacacttcacacccaaagccaagtgctacagaagcctccgtgaagaacaatgtagaagtgtttgtaaaggagcaataacactgcaaggcaagcatcagaaatagtaaaggggactgaaagaatagaaaataaaacaaaaaaaatcaaattttttaaaataaacatcgttggcccatgccacatcttttctggattaagctagatggacattttgtgaaagttcattttggagagttttttgtttttggccccagttcacctactccagccctcttgcatctctgtaaagcctctcctctctgtaccttttgcttcaccattcagtgcatgagtgtcttcaacaaaaaactttttgttgaaaattctaggatttaccttctcataatacaaattctcaaagctttataatgagtcagaaactttccaagccttctaacagaaagagcattaaatcattatttaattttaaaacatatggtttactgaattctttattgattttacaaacaagattatttggctgactgagtatatgggtgtgtatactttgctctctcaaaactgtcaaattagtctgcacaggaagatgcaccccttatgtttcagtcactcaagtgctctttatctctaacagtctgagcttcaacagggactgttttatcctcttactcatgtgaatgtgaataggaagtctatacaggtgctggtttgagtaatggaatttacgacagacccagcctctgttctatcaaattaaggatacagatggccctttgaatacaacaacaacaaaaaagtgaggcaagagtagaatctgaagggacacccataaaaccaaggtgacataggcatttactacaccaaaaagaaaggttgtttagatttgttgccagaacgtaaaaaaagaaaaatgtgtgttcctcattttcctggctctgcagcttatattttcaacatctttgtgagggcttctgttgccattgcattactttctggctgtctggatgggttgctctggtgtggagcgagcatcctcacaatgatcccacactgtctgcaggccactcctgatcttccacaatgtatttctgatgcccacaaatggccatgggcttgtttcttccctgacgtagccttgtctaccgtgtgagggagtgaggtcccacacactggatctcaaagaaggttcaaacatacacttaagcattcctgtgataattgccaacccatgggggacagtaggagactataaattgtcctgtctggctatgtcattccctcatactgcagagtaaagcaagaccttggggaggtagaggttagaagcaggggcctcagaaggtgactgtggagtgtcctctttccctgaggtacctctatttgcctcctttgtctgtagccctctcaatttaatctcaatattctggctcccagggaaagctgcttttttttttttttttttttttttttgagatagggtctcactctgtcacccaggctggagtgcgaatggcataatcgtagctcactgcagctcaaactaaatcctggactcaaggaatcctcctatcttagtctaccaagttgatgggactacaggcaagtaccaccacacccagctagtttttaaaaagattttttttttgtagagatgaaatctcactatgttgcccagactcatctgtaattcctgttctcaagcagaaatctgcatttttaaccaacacttcaataggttctaaggcagagacttcaaggagaatgcctgctacgttcaaaaagcaccagcctacatagtaaagccgagtcccttagcgtggtattggtgaatttttccagctccctcttctgctcctctcctgcacccacttcacttaacccacaactccctgcaattaacatttggccaaaactgaactcttaacattttctgaacacacggagttacatcaaaattcagagcttttgcaccgactacaatggcctgttttcatcttcaggccttgcaaagtcctgcttattttgaaagaggcagtgtggagccactttatctgataatgccctatggttcccttcctgctcttttatgcaccctctgtcttctttctcaagccataattcctcctctctccctctgtggggttaattcgcttacacttctcattgtccttatcatactcaatggaaaaaccaaatcacctcctccttaaagtttttgcagattttgtgagatatgctgtttcttaaatatccatgatgttttcttaacctgccttatgtcacctgtcacattctatcttaaaattaatggtatatgttaataatatttactgttaataatgtgctaattatgtaatgtactattatgtagtaccactaataaaattaatagcacatattgatagtacatagtacatatatgtacatatatatagcacttgatatgtgtcagaccctattctaagcacttttcataattaacacacttaagcctcatatcaacttttggaagtgtcactattaccccccattttgcaggtgaggaaattaaaaacagaagggctaagtggcttacaaagtcacaccactactaagtggctaagccatagttcaaacctggttagtcttgttccagagaccatgctcctaactgttactctacatagctcctttgtgtttttggagttgtttatgtacttaacacgacttttttttcttccctcttggcatcctgtggctcctggaacatggtgagcactcttcaaacacttgaggagtgaaactacatgggaagagtttttttaggaggtcatagaattctcacgtttgggaactgacatgatttgactctgtgtccccacccaaatctcatcttgaattgtaatccccacatgtcagaagaggggcctaatgggaggtgattagattatggggatggatttcccctttgctgttctcgtgatagtgagtgggttctcatgagatctgatggtttaaaagtgtggcacttcccctttcaatctctctctcctgttgccatgtaagatgtgccttgcttcccctttgccttccgtcatgtttgtaagttttctggggcctccccagtcatgtgaaactgtaagtcaattaaacctcttttctttataaatgacccagtcccaggtatgtttttatagcaataggagaacggactaatacaggaacccttagggaaaaaacttcattatatctgaaactgaaatttctggtgatggtaaagggcaaagcataaatccgtactggaagttagcattttctcatgattcttcttctcttgcatacctttccaagtagttttcattttcatttgttttacattttcttaagatatgttcacacttatattttaaactatggaaagaaaaagatcacttgcaaatgccaactgggaagagtgtttattttaaacaatgctgttccggtgcaccagctgctgttgctatgcttgtatattggttgctaggggtagtgaggagaattaagcctgtgatgtcaaggtgacaagttgcttcaaccctatgttctattggctaggatttttctgagatgaggaaatctcagtcctgagcaattagcaaagtacttggtttcaacttgcagaaataactcatattgcaataagtttattgtaatctagtagttttctaagggtagaagaaactcggaaagtaaatatagtacctgggattttaggattcagaatttggacaagattttttaaaagtttacatttcccccaagggataattaaaccattacagaaagttaatatcagtgctgtaaaatgagaaaaggaaaacctgcctttaatgccagggtatgttatctgtccaaaaggggatttatttaaatatgtcagttgccatatcaacactggaaaagagacttcactattttcgaaattatcccactatgaaagtaggtttgtagattcgagtttatacagaaaatatttgtgtgtgcataatgttgcctggaatttacattcaaactgattaaaaattccttaagcacctgctacaagtaaaacattgtcttaggaatgcagagtgatccaaccatcccagtttgcttggagctgccccagttttggtactgaaaaatctcatgtcctgggaaacccctcagtcctgggcaaactgagaccggtggttatcatacaaagagaaaaccaaataagactaaaattatgtccaaacactttcattgtggctaggaacacaagttgaacaccctaataaggaacacaaataataaaagcttgcattattgagtgcttatatgaggtaagtattatactattatctccattttaaagataagcaaactgagacatagtaagggtaaataagttagttagtgaaggcaccagaatttaaacccagaaagtttggttttagagcatacactacaatcagcactgtatggaaagatatctaagagcagagacaggcagagatgggagcactggggaagacatcatggaggggctagatggctacatcttggctttaaaaagtgagcaaaagtaagagttagaaaggagatgaaagtatcatttataaatgggaaaatcacacaagcagtggtctgtagtgatcacacaagcagtggactggagtgaagaatgggctgaaccttctttttccagaggcagaaaggagtaagttttagggaaaaggttggagcccttttccctaataggggggtactggtacaaatgaatgtaaagagagagagaaagagagagagaagaacaaagaaaagaaaagaaagagaaagaaaagaatagagagggagagggaagaagggagggaaggagggaagggaggaaggaaggaagggagggagaagctttcctaggagagatttaacctcttgggtcacagacaaggtcacctactgagcggtggattgagagctaggggaaagctgtgaaggtttacaagctcctttcttgagctgttttaggaaatccacaggtgtccaacaagaggattcctgagcagtaggagggagttgaaattgcacagtaataatttttaattcaaaaataacatagccatattataagaaattctggaaaatggagaaatcttccataaagtatgctataattttggatttttaccatatgtttgtttctttttttctttttcttttattattatactttaagttttagggtacatgtgcacattgtgcaggttagttacgtatgtatacatgtgccacgctgttgcgctgcacccactaactcgtcatctagcattaggtatatctcccaatgctatccctcccccctcccccaaccccacagcaggccccagagtgcgatgttccccttcctgtgtccatgtgatctcattgttcagttcccacctatgagtgagaatatacggtgtttggttttttgttcttgcgatagtttactgagaatgatgattctttcacacctaaaatcatagtgtacttatagatccaaatcatgcatttgttttttacttaatttattactataagtattttccatgttattgcatagtctttataaccatcattttaaagaccagttaatacattatctggggttttaagattcagaatttggacaagagttttaaaactttacagctctccaaggatgattaaaccattacagaaggttatatccgtgttgggtatctatcctgggtatagtccataatttccttaatcattatacttcgttaatatttctaacgttttccttccataaatgaagctagaatgacatcttcaggcttatatttttcccacaatccagctagctctcatatgggtcttatattttgtcttttcttagcttccatgtggctatgaataagattcatttttcacataaacatacacatgctaacatatccaagtgtgtgttgtctcctttaaagaagcaaaaagtgtttcctcggagaagcatttacttatcttgctggcatttttaatgactttgaatgtttggatctgttttcttctttgtaatgccttcagatatatctttgccacctgggaatattggcctgtgtcttgtctatatcctcaattctcattatttagccacatcacttcctgccttagaggacttagcattaaataacattgggtttgaccaaaatctttattaccacccagactttcacctcagaaatccctgcctctgttcccagcttctgacaatagcccatacacacccttgtgtctctctcaaaccccgatccctccctgctgctgatggagctcatagagatctcttcttcccattttttttcaaatctttaaaccagctcttaacttcccagcttttccctcttatgcctgtgacttccttcatcccctcttccagcagccccctgtcctgcctcacctttctactgccctgtcctaccaatgctcaccctgggccagttcacctgcatgcagtctccacccccacacctggcccagagccctgctgggtccagtagcaggggatacctcacaaatgtggcctcccatccaagctgtgtcctcaggcttctcagcagcctttccctctcagggacttccccagtctcccatgtccctgactacctgtattcttcagctcttggctcttgaacagtaactcctttgttatctcagagaaaacagaggctgacaggtgtgaacttcttgatcttcccactccatacctgtaaatttgtctttctttaaatcctgcctttctttcttcttctttttctcagagaaagtattgctcctttttctgtctaaagcgaatccttttactttccactgatactgtcccattcagattcctctgagaccatgtcccatcaataataagttctctttcatttccactggttccttctttcaacatggagatacacttaagactctcccatcttaagggagaaaggaagacagagttataataagtgcctactgtatgttggttacttgagaatatattatcttatataatcctcataacaggtttattagttaggtgttattatctttattctttgatttagataagaaaaccaagattcagggaggttaaatggaccaaagttttaagttagtaagtggcagagccagaattgaaactgacttggtctaatggcaaaaccatgaatgctgccctattagcccactccaatttcacttgtctttcccttcacaatcatatttcttaatagagtaacaaatcacttaagttctacttcaacctgatttgctaatgagttgtctctgtgggattgtttaagatgtatctacacactgaatatggaaccaggagcttcttacccaacctagatagcacttgattggtcagcaatgcagaaagaaaccttgctgaccaggtttctttggctacccacttgacttgtggatattaatcaccatctgcagtaacttttttcacaggaagggtaatactatatacatgaataataacagtcagtgatatgatgatgaatgtttaacaactgctctctgaataaagatctttgattagtagtgtttgccaatttctatagtgaaatactcccaccatgaggagtatttaataatgcctatgtttaataactttcttgtaaaatcctaaaaatttaacaatcacaagactttctgagctggttccagtacaccattgtattagctaacagttattgagtacttattaagtgttttcagcattctaaatgccaagaagtattatcccactaatcctgcaatacatttttatccatttcacagatgaagaaactgagagattaactggccaaggtcatgccatcatgtgtgggatctagaattatactgagcgcctaaaaatgctattttcctttatgaaaaaaatatacaaacacctcactactttagccttctttatttctaataatgttttaaggatctggttcaaattttgacatcatatgatttatggagaagatgtatatttaaaataaatatgtaatgttctaccttagtagaagtaagtaccagggaggcaggagtctgatcttctgatgattctgtatatctaacattaagctcagtgtacagcatgtagcaataacttataaaaagtgctgaaacaatgtaatatggtaattcttataccttcaatgaaagtcccctaaaacctctgtaaggtatgtaaatgtatttcaaataattaaagattttatgtttatatcccttgacaaaataatactactctcgggatttaatccttaggaactaattcaatagaaggaagagaaaaaacagattatgcaaagagaaaaaatgttcattgcagtgctagctacagaagcagagaaatgagatatacataaatatccaaaaatagggaaaaggttaaattacaatacatttcttcatgtgacttgcaggtagccaatgaaaatgataagttaatttaccaagatgaaaaaattagagcaggacataaaagtttattcacaacttgattgggaacatgttaatggccaagagtacagggtttagatttggacctggactcgatcccaggatcttttaccttgtcatgccacctagggcaagttgcttaactttcctaagtctcattctcccctttaaaatgaggacaacactctcagagtcattgtggggactaaatgagcaactatggacagtgcctgggacagcatcaggcacacatatctagtacatatgcataggagcaagggctggtagggaatatggacaaagaaaaaataattgatgcctttgggtagaaaaactgtggcttaatttaaatttttttttgatattttcctttgctgtgcaaaagctctttagtttgataaggttccacttgtctatttttgtttttgttgcaattgcttctgaggacttagccaaaaattctttgccaaagccagtgttaagaagagtacttcttaggttgtctgtcttccaggatttttatagtttgaggtcttgtatttaagtttttaatgtattttgagttaatttttgtatatggtggaaggtaggggtctagcttcaatcttctgtgtatagccagccagttatcccagcaccatttattgattagcgattcctttccccattgcttgtttttgttggccttgttgaagataagatggttgtaggtgtataggtttgtttctgagtttcctcttctgttccactgacctgtgtgtctgtttttgtaccagtaccaagctgttttggttacggtggctttacagtatatatattttgatgtcaggtagtgtgatgcctccagttttgttctttttttaaggattgctttggttatttaggctcttttttttggtctcatatgaattttagaatagtttttattctgtgaagaatgactttgggagtttgataggaatagcattgaatctgtaaattgctttcagcagtatggccattttttctgattttgattctttcagtccatgagcatggcatgtctttccatttatttgtgtcatctacagcctacagaatggaagaagatactcacaaactatgcatcagataaatgcctagtatccagaatcaatagggaacttaaatcaacaagcaaaaatcaaataaccccatcaaaatatggataaaggacatgaacagacacttctcaaaagaagacatacaagtggctaacacacatacggaaaaacgctcagcatcactaatcatcagagaaatgcaaatcaaaacacaaagagataccatattatactaatcagaatggccattattaaacagatgctggtaagactatggagaaaagggagtgcttataccctgttcattggaatgtaaattagtttagccactgtgggaagcagtctggagatttctcaaagaacttaaaacagggctaccatttgacccagcaatcccatcactgggtatatacccaaaagaaaataaatcattctaccgaaaagacatatgcacttgtatgtttattgcagtgctatttacactaacaaagacatggaatcaacccaggtatgcagcaatggtagattggataaagaaaatgtggtacatatacaccatggaatactatacagccataaaaagaatgaaatcatgtactttgcagcaacatgaatggagctggaggccataatcctaagcaaattcatgcaggaacaaaaagcagctacatacaccatgtcctcacttataaatgggaggtaaacattgaacacacatagacataaatatgggaacaatagagactgtggactatgagagggtggcaggggggtgggttcgaaaactacctattgagggctatgctcactactagggtgatgggattgcagtattcccatgtgacaaatctgcacatgtaccctctctatctaaaataaaagttaaaattaaaaaaaaacaattataatggacaaaataacataaatatacttccaaatatttaaatgggaaaaaattgtattacatgacatatatgcaataaataaacaactaatggaaaaaggaaatcgtatttaaaatattaaggttagtcacgtttaaaataaattaaatttatctcttatttagactcctgtcactccaaacaagtgaagtcagccaaatggaccatgatgatttctctcagggtagtcctgtgagggactgacgcttctgtgtttcctactgctcgtgaactattgagaatctgccaccgttcactggttcacacaatttccacaagacaaatgtggagttagactcattttcatgctatatgggtatgcagaatcatgcccatctgatgataacgatggtgttgcctggtcctttggattcctgctcacatgtggaaggtatcttgtaccttccaggttatcagatcatacactactgtttttcttcttcctccttgttcatcttcctcttatcagactaaaatttttaaagatgaattaaagatgcctgcattatttatcccttgacctgcaaacaaccagtaacttcttggaatgtttcaaaacctaagctttagttctaataaactttatttgggtgagcactttgcggggtccaccatgcaatattcaaatcacatttttactaagaggaaaatcattgagtgtttaatatatctgaagtcattatgatagagttccatgtagcaagaatcaataataattaccttggtgtaaattattttcattctttagggaaagcctcaagactcaaagatatttttagagagaatacttttctgagtcttcaactcaagcaaatataaaatccagggttcagtgtaagctcaaggcttgtcactacctgctcaaatgtgagagctggtgctttaggcatgcccaagtctgccaagaggcatgcgtcctcttattagtgggggcatttaattaaaccaagacagtctttctgcctgaccagggcaactactgatgagaataaaattgatgggagatgaacagttaacagcaggagatacatgggaacaagaaataaaagagccacagtcaaactgaagaatattgctgtagtatattatatttgacatttgctgctgtgtctagtaatgcatcccttacttctctctcgcagccatgttacttcattattttaaattttagaagctttgttttttaaaaaatgacaaaaatctattttttgttcctcattagggtgcatatttaattgagttcctctgttcattatatttgaatgttgccattcaaccagaggaaggctggcaaaaatcatgtaaatggctatgcctggcttttccaaagtatttaaaattctgtcgttgtttccataagccacagacggtgggttatatttcatggacagacagtgcattcttctcttggggtttttatggacagactgtataaaatgataacacaatgaatggggtaccagctctactatatcaagggcttaaatcagctatttcagacagaaactcaatgtggtagagcacgtttcaaataggtttgcaggtacaggctatcacacaaaatttctacatcttttgtgattaattctcatgaaaggttaatgacattttttacaataaattagagctaaggttagggagattttggtaatatagattcaggtggtgacctgaataaaattgataagatttgcatgccggaattgaaatagagatatgatccatcttcaaaatgacaagggtttggatgattgtggagatatagcaaaggtgaatcttctacttacctattcatagtccttcccatatcatatgatagtttttatgattttataatgccatctttactagagcacattcccccacttccatgctctcctttcctaaagggaagtttcttctctgcaattgtttaaatgaagctattttaaggttaatttataattaacccgaagtgaatcatagtcattagagcttcctttttgctgtttgttttaaatctgttttggaaaaaatggtttaaagtgatttcttaaagctatctctaaggagtgtgaagaaacatctatttgcaattaatgatgcagaaaatcaagaattacccccagtttgccagtgaagaatattttgcatcagtttgaaattctctttaatggaaaaaaatcaaagggagttaatttttatgcatagcctttgatacaaacttaaatttctagctacccaggtgtgatatgtgatccagatcatttttccagttgtatttctcttgagaatcctaagttttggtgtaggatttctttattcagaatgattatggctaataatctataattattaaatttaataatcaaatgcaacactcaatattgcaataatatattacgtaatatacaccaaaatatttgttctaaatcattgaaagaatttctgtattctatgagcttctcatttaatctttttctaattattgtgatttgtatacttgcaaagaaatcatattgtgcaatgcactggaaagtaccatattttgactatctaaaaaataatagggaaaatgcaacttcaaatactcataaattatgatactcttcatgatcaatctgttttatttattttcttatttatgtctcattcactcccaagaaggagataaggtggcttatagttagagtgaccatataatttatcttccaaacttttgagagtgaaagtttaatcatcatgctggggcaaaagacataagctagcactatcccaggaaaggtggaagatatagtcataccaaaaatctcaaatacaataaaaccatagcctagacaacacaacataaaagggcaaggaagttataagacagagtattgtacattgtgtctggaaagacattcaagcatgcttgcttggttttggtctttctagacacgacatacagtatatcacttagcaggttatgagccagggatctcctatattaatattttctaagtcataaggaatcccgtattagctagggtaggctagctgctataaaaaggaactctacaatctcagtggcataagaccataaatgttcatttctcactcacatcaatgttcatcacagattggtgagaaagtggtgatctatgggccatggctcagtaacctaggcagacaaaggttcccttcttttgaacttggcacaagaaaggaagccttaggttaaaaacagtcagccaaaaaaatgtcagaagagaaagtgtgtggaggattgcatggaattttgtgccaatttcgcaagtgacgtgcatcgcctcctcccacataggtccaaaactcaatttcattatcccatctaactgcaaggggaactgggaaccatgttctgactgtctactcaggatgaagtggaaatggggtttggtgagcacctatcaatctctctctctctccccattttggtcaccaagcactcatttcacacttcatcctttaggcagaatgaggaaatctgaatccctgcgtggacttcagagtctagaatctctgggaggtgcctggtccaacttaacagcttcagaggtggcttcttaccacctgctgacctatgaattaaaaaggcaaaaattatcaactcaccctcctctgtaccttcagcaaaccatagcagaacaaggataaacaccatggctggcatttttcaacagggaaaaacagataatcaatagtcagctagaaagcatttttcttacctttgcttttgcagatccttgcattattctttaatttcaatcacaaatgtcatatcctttcttttttgctattattcatcttgagaaattgccaaagtatttgtatcatattaagaacctattaaatctgtttggtctcttgtagctcagattagcaactatgaagctacttagtaaaatactctatagtccttattatttaaagcatataatggagttaacaacaaaaagcttctttatcagtgatttataaggattacagaagaagatttacgagctctagaagagttgaggaaattacttctgaagcaagatacgcaggaaagaaagaaatagtacaaaagcaaagttctttggtttcatgacatttaaattattgttaactggcatatattggtctgtgcctccctaaacttgggcactttctgtttgtttttctgtttagtgcctagggaccataatgacagccactacattttgttggcacaaatgccactgctgcagagaactgagaaaatatgtgaaactttgataatatttgttgaagattttaagtcctgaaataagaatagaagtaagtagttgtatgcaaacattttaaatttcaaaataattttagattcacaagagttgcaatcctagtacagagagtttctgtataccctgcatccagtttctcctcatgttaacatctaatgtagccaggtacagttatcaaagtaagaaattcaaactggcataatataactgaccaaaccacagacttcatttagatcattatttttcccactaattttttttttctgttctggcatctaatccaggatcccacattaaattctgttggcatgtctccttaatctcctctaatctgcaactggtcctcattattgccttgttttctatcaccttaactcctttgaagaatactatcaggtattttgtagaatgtcccacaattttggtttgcctgatgttttctcagggttagacttaggttatgagtttgggagaataccacagaggtaaagtgcgtgctttgctgtgtcatataaggagccacatgatattaccctgacttatcactagtgatattatctttgttcacttgtataaagtgatatctgtcaggtttctttatggtaaaggtactatttttctttttgtaattaatagatattcagggagatagtttgggtcagtgcttgcattttatctttcactgcagacacctgcttttccctaggttctgagtagttgctggccctacaacctcagcattctgatgggtagaagtttgtaaacttactgtttgtcagtaattttgtcgtaagcttgagaatagcactgtttccatctcagcagaaactggaagtccagtatttggagttcaaataagtgctcttcatattaactgttattgttagttgtcagaagatcaatactccatttcattctagaagatcagtcttagtcaaatttcatcatcccgtttcttctgctagtgatgtgctttggaatcagtatgtgactgacttgtagccaatgagatatgagaggaagcatgctcttgttttcctaaggaaaaattcttttctcttaataggggaaaataagtaaaagatagttcaccttctacctctggacataggtatgtctggatatattgcttaaaactgtggctaccattttgtttccaatatgaaactgaggccaacactgaaaacagcaaaacaaaagcaggaaagaacctggatctttgatcatattactaagctgtcattccaatcaaccatggtactgagcctacctatggatttctagttacgagcaatagtaaatttctttattgtttaagccaatttgagttttggtatttcaattacttggatcccaatggcttatagctgatatcaccactttaaggaaagtatgatttttatgcaaatatattacagcctatttatctgttctattgttaatgggcatttggattatttccagttttattgtttaggaactgtgcggctatgaacattctaatagatgtcttttgttggaatgtccacatttcttttgcatgtacatatagccaagaatgaaattgctcagttagaaacaatgttcatgttaggttttagtagctattgcgaaaagcttttctaaagggtttatattaatttacactcttaccagaaatgtatgagagttatagttgctccatgtccttgtcaacacttggtactatcagtcttttttttaggacttctttttttttttttttttttgagatggagtctcactgtgtcacccaggctggagtgcagtggcacaatctgggctcactgcaagctccgcctcccgggttcacgccattctcctgcctcagctgcctgagtagctgggactacaggcacccaccactatgcccggctaattttttgtatttttttgtattttctttcttttttttttttttttagtagagacagggtttcactgtgttagccaggatggtctcgatctcctgacctcatgatccacccacctcagcctcccaaagtgtttaggacttctaatgcttgtataagtatagtagtatcacattgtgactaatgatttttatatatatattcataattatatcagttctaaagtaatgtctatatactttatcattttagaaccatagcctaagtataaattgttgggaaaccattagaagacagttaatagtcatgcaaacttaagtagaaggtaagagaaataagaagggagagatattaaacttaagtgtatgttgttctataaataagctctagtctatttctaagggtaggttttgttttgtagagtagaacagcaagattaaaacaaaagacagaaactgctccaacttatgacatgttagacataaaacatactcatcagtaggagagacataaaaaggcacagtgaaaagaagggtcttcatcaagtcacttatttttttgtcggggagggggtagggggcttatctgtaaagtgaggaaatggagttagaagattttcctactttcttcacattcttttaatgtaaatatttcttgtcatccacatcagaccgtgagactaagtctgaggcaaggagggctcctaaggctcaaatcattgcctatgacccctggagatcaggtacctagatggtaggatttctttggttctttggttcaaatccatattagtcagggttctcttagagcgacagaactaataggatatatatatatatctataaagggaagtttattaagtattaacttacacggtcacaaggttccaccataggctgtctgcaagctgaggagcaaggagagccagtccgagtctcaaaactgaagaacttggagtttgatgttcgagggcaggaaacatccagcacaggagaaagatgtagggtgggaggctaggcccatctctctttttcacatttttccgcctgcttatatttgctggaagctgattagattgtgcccaccagattaacagtagatctgccttccccagcccactgactcaaatgtcaatctctattggcaatactcagagacatatacaggattaatactttgtatccctcaatccaatcaagttgacactcagtattaaccgtcacaagtccatcccttgtcaacttgaacctgtacacatctcttgagatcatacataatcttcaaataaagataataatgaggtaataattacacctaacataatacaaccagccttcgtacaactggaaatgcatcaatcccaaacccaagtacaattacataaagttaacaatacttaaaggcttatatgaagtcaataaatcttacgtcacatgataaaagaaaaggaaatgaagatattttcttagtacaagtatatacatgcacaaacatgtttttaacaaaagaaggaggaaatactcatgacagttacagtccttgtttctgcagctggtcacgtggctgtagctggtatttatgactaccttcttctactacccattctgtattccctttgccttcagcaagcacctcagtaggttgtgggcgttcttcctggtggagtaacctaaaccttcatacctgaaaggtctgggtcatttgtagtcctgcctggattgtactgttgtagtttcccattgaccttaatcacagagcatggtaatactcagagacgccctaatggatctcctgtattccatgcatactctactccattgtggagtagtagactgatttcatcttgatagtctgggtcaatcaccccagccaacactgtaacttccttcttagactgttgacttaaaggtaggagaagcccaaagtgtccaggtggcaatcttaacttccagtttaatggaattgttgttgtgtctcctggtggcagtgttcctccctctggaactaagacctctaggccagcagaacataatgtcgtgggaacaggaagcaaaaattttgccagtagatcactggggtgatggtgagtgttgccacttccacttccacccattgattcccggacccgtgaatcctggttatgggagaaacagtaccatatgttggatactggttcagagcatacatggtcttctggagagctttgccccagccctgcaaagtattgtcacctagttggcattgtaattgtgacttcaaaaggccattctactgttctatctgtctagctacttcaggatgatggggaacatggtaaaaccagtgaattccatgagcacaagcccactggcgcacttctttagctgtagagtgagtgccttggtcagagacaatgctgtgtggaatactatgacagtggacaagatattctgtgagtctatggttagtagtcttggcagaagcattatgtgcaggataggcaatcccatatctggagtaagtgtctattccagtgaggacaaacctctgccctttccatgatggaagaattccaatataatcagcctgccaccaggtagctggctggtcatccccaggaatggtgccatatcgagggttcagtgttggtctctgctgctggcaaattgggcactcaggagtggctgtagccaggtcatccttggcgagtagaagtccatgctgctgagcccatgtgtaacctccatccctgccaccatggccactttgttcatgggtccattgggtcatgacaggagtggctgtggaaagaggctgagtggtgtccacagaatgggtcatcctatccacttgattattaaactcctcctccactgaggtcacctgctgataggcactcacatggcatacaaatattttcacagtttttgaccactcagagaggtccatccacatacctcttccccaaatttctgtcaccaattttccaaccatgcttcttccaagtccctgaccatccaaccaaaccattggctgcagcccatgaatcagtaatataatcacacatctggatatttcttcttccatgtaaagtgcacaaccaggtgcactgctcaaagctctgcccactgggaagatttcccttcactgctgtccttcagggatgtcctggaaaggggctgtagtgctgcagctgtccacttttgggtggtgcctgcatatcgtgcagaaccatctgtgaaccaggccctagttttctcttcctctgtcaattgataatagggaactccccctgaggccatcagtgcaggctgggaaagagaaggcagggtggcaggagtggagaccatgggcatttgagccacttcctcatgtaacttacttgtgccttcagggcctgctcgagcccgatcaggtagataccacttccatctgattatggaatgctgctgagcatgacccactttatggctagatgggtcataaagcacccagttcatgataggcagttcaggttgcatggtgagttgatgacccatagtcaaacattcagtttccaccaaagcccagtaacaggccatgagctgtctctcaaaaggaaggtagttatctgcagaagatggcagggccttgctccaaaatcctagaggcctctgctgtgattaatctataggagcctgccaaaggttcaaacagcatccctatctgccactgacacctcaggcatcattggatctgaatgaaaatagaatttcattctattttctttccaaataattacaattgatagagactgaaaaaaatgtatagtgcccagtggtcatatggcccaagtggcagagcagcttgcatagcagtctggatctgttgcagagccttctcctgttctggaccccactcaccatctgaatgtgagctttggtgatatgagatatggacacttctctggagaaaagggttcattttctccttaggctgaaactcatacttgtgagcagcaataaaggtcagtgtaacaaaggttggggcatgaaaagctccattgtttgttttgaaaagagagagctcattataagacaaatgactatttggactcaaaaacttctgacagaaacatatctgcacattggtaacttaaatatctgttacaaatgtctgtgcaagtctctatgtttatttagggtgaccctttaagatcatggattgtgactgagaactggaccagacaatttattcaatggatatgttaaagttctattaaaatgtcaatgagagaaacattttcttgggcagtgatgttaatatttaaagtctggttggataagcagatattttctctggcattaagtcttcattttctatttgctttgaaatttgttgctcttttttttgaaaacatctatccacatgttgtttcctagttttcaagtaaaattcatgataaaagcatttcctccttttttataatcatggtttactcctcatttgaatctgtcaagcaatatttagtgttggccaattaagtgttttagcacttcacagatctgctctgttgatattctagtagtatcacatcatggcacagataatgagacataggtttgcttggtgctatgctcaaaacctttgtgtcccctgaaattcattgtgttgaaacctaatcagtaatgtgatggcattagaaggtggagcctttgagaggtgatcgggtcacgaagacagagcattttaattgtttgtctggttactccaagtgtttgaagattaaaaactatttcatttaagttagtttttagttctccattaattatggttacataactaatttacattataaacaactgttattaaacaaagaaaaatttcattctattttctgcccaaataattataactgatagagactgaaaaaacatgtgtagtgcccttattaaagaggccccagagagctgccttgcccctttcaccatgtgaggacacagtgagaagtcagctgtctgtagcccagaagaaggccctcaccagaacctgaccatggaggcaccctgatctcagacttccagcctccagaaccgtgagaaacaaatttccgttgtttataagccacctggtctatggtatttcgttatagaagcctaaactgagtaagacactttggctacctggttctggtggttcagctctgaccatcaatcaaattcaggttcagatcttcttggcattttgtacttaagagccatttatatctgacatatggtggtaagttccttttttttttccccctgttacagtaatagtaaaaccttggctggttaaatcctgggcattcctatttgtgaagtgcatttttgtttatagggtaatttcttaatttctacaatttccaaaaatgtacaagggacagcatgaaacaagtgtgcaccacgcagtatcatagatgcactttcaataacagctcccttatttctcagccatgtggcctttggaaatccatttaatctcattctgtcatctaaaaaaaaaaaaaaggtggtatcatcttcctggggggctatgcaaattgagatgcaataaatttaaagtacctggcatggagtgactacttaatacttggtggttagttttatttattttactttttttgagacagaatctctgtctgtcacccaggttggagtgcagtggcacgatctcagctcactgcaacctcggtctcctgggttcaagcaattctcccaattcagcctcccaagtagctgggattataggcacctgccaccacgcccagctaatgtttgcatttttggtagagacggggtttcaccacgtcggcccggctggtctcaaactcctgacctcaggtgatctgcccaccttggcctcccaaagtgctgggattataggtgtgagacaccatgcctggacttggtggttattttaattacaagaaacacctcctctccctcatgtattcattgcgtcctcaacgagaagtttctcctttctgcaatgacaaaatctctgcatttcagctggataaatagctaggaagctgagaaataaatacttctgatattccagagatggttgaacataatctgcttctttttaatgaagcagattctgttaagataaatatttgaatattaagaaattacaccagtgatttaatttttcaggcaagaattgaagtataaagcagtggatatttattttttatttttaaaattttattattattatactttaagttttagggtacatgtgcacaatgtgcaggttagttacatatgtatacatgtgccatgcgggcagaaactctacctaatgctaaatgacgagttatttattttttaaaatgattatttgtattggcttttagttttctttttaaataaatctgtactatttagaaaagataaagtcatcacctacgcaggtaaagaaaaaggaacatctttaacgttttctagataatggcatgcatcctaaacattgttataaaataatgaagattttgaatttcttttaataaacctcttaaaacagtgttatttcaaaattatattactaactctttttgttagtaggaatatatatttcatgagttactttttctaagcagtattttagtcagataatacatatcttttgctttaaatgcattttatctgtgtggaaagcagtattacaggctacatctttgccagtagttcatatcactttgtccaagcagaagatactaaagcttgatagcactgggggcagaattagagaactagatttgactgattagctaacagaagctaagtccagtttcctaaccttgagtgtgagacactagtgctcctgaattgtctaactgagcatccaccgtgtggaagacaccattttggtgtttcaacaatgtcagtcaacaaaacagagccaaatttattttctgcagagcctattttttggtgtgggggctgtgaaaacagcataaaatcaaaattatcaggtggaaacagaccatactattgtcttaatatagtctctctgacttcttgaaatttactgaaagctatgggatctctggcccattttgctaactttctgataacccagctctgctgtcagagtacgaggaatcaatcctccacttcaccacccacccagagtgctgaatgccactcaccaccgcagggtcgccagggggcgcaactgagtctacggccaagtgaaaaaatattcggcttaagatctggcctgtccccagctgagcccattccttagaaaggaatatcactagataatttattctggagtgtgaggtggggtggggttgccttcttcactaggcacaaaaatgttccaggatgcttgttaaacctggctcagggcaggaatctgcacttttaacatcctccctagtccttccttgctctactaattgggatgcggggtgtctggcctttcctgaggtggaaaaaagaaaaggctggcagagcaacaaagttctctcataataatgtggttgttattgaacagatatgaggctatggaactctgttctgaaagagtaataaaagttaggaataccagagatttctgtccgtgactcctcagtgaccatcacagttaatgggcaatatcctctttgtcacccacagctccaactgtaactactctgttgcaagggcagcattcctgatagcggcggactgggaagatgtgtggtatttgattagcttggtttctctactcaaaagattggcattaaaattatttttgtaatatgttgccatatttttaagcctgaaaattatatactaatttggatatctcaatggggaaatgactgctctccccttattccaaatgttgcaaatttagatttttaaaaagtaatagattatatttaaataggtaattatacagataataccaaagccaaaagaaataaatgatacaggtgcacagtaattttgcatactagttttatttcttagtctcccactttgtctctctgaataaccatttgtaccaatttagagatatgtaggcatctatggttgtataccataagcattgctttgcacccttttttagaatttgtgggttttttctaatgatatgtcttggtgattggtctgtgtacacacatatttatatacctttttcttgttaatagtttcaccgtagtctgtctatgcatgggcagtaattgattttacctgtctcctattgatgaacatttgagttgtcttcagtcttttactctattaagcaatgctgtaatgaatatcttttcacatacatctttgcacactgtggaaataaagaccaaccaaatgagaaaagcaaaggctatgtattcaaagcttgctgtagtaaggaatcagccactgtcacttggtttggcagagtatcaaaggctggcagaggaaaagggaatctttaaactagaaaaaagtgaaggcttcaggtataaaggctgattggaggctgttggcctgggaatgctatcggtgagctaactagaagtgggacatcctatggagttggttaggagtgcatatttagctttctttggttcatcctaagttgaaagcagggaccaaaaaatagagaaactgtcagttattaatcaataactggccctttttgggtgattgctacagagttagtgtttaccttcccggattgttactagagatagcaacctggcttcctgcaagtctgacttataacaggttatttattatagataaggggggagtaatttcctgggcgggttactgcagcctgtgagtcagagctgcatttttatatatggtacagctattgtccatttgtatattcagtttctcaatacctatgtgaatatatttgtatatatttaatatggtatatacttactacaaataaaatatttattttagaaatacattcctgaaagttgaattgagtcaaagatttatgacatttaatttatgtatgttttgaccaattacaaaatttgataaatttataattcccatactcttctggggatataacagggtatattaccaaactttttaaatctttgcctgtctgataggtaaaaattcatatctcagtgtagtttaatttatacttgagattgagaatgttttttcatgtgttaaataattttttttcttctttgtgaaatatttattcatgtctctgttattagcatatttttaagtgctcccaggccagggaagttattgataacagagtaagtctctggaattattaccttaaaacattcaatttggaatcaggcctgggaatgtctaaaatattggggaatagaatagattattagagaagttaacttctttttaaacacctctaaccagcatctatctttttctcttatggaggattaataatagagggactaaaggtattgatgatagaggcagagttttaatctggaattctaatccatttttgctttcattttctacgtgaatcttgagatattcaactatgacatcagaaatagaattattacttatctgagtgatctaaaaaaagcaataataaaacaatgaatattatcttagatactttttccatacagtataatcttaaatagtcctgaccaagtatgtatttgcatttggaaaatgtttctgtcttcatgaagttgtatgtattagtgtttataactgagaccaaatagtgttcactaattaaggtcctattgagtttggtaacttctttatgcatcaattccatatgtcctacactgtagacagtatctctgccacaacactagattttagaaagaaatgagaccttatccgagaccttatcctcacctgttcaagtcaccgtaattattaagataagaattagcagtatttttccatagattttacactttctcctcaactctgctttgatatttctgaagattttctttccagaaaaatatttgttttaatgtctccagtttgatagttgaagcaacacacttgtaagccagaagtaaatcataaatcattcgtctgtaagtttacaccacaatctttgatatttgaagagaggttatacatacacatacacacatgcaatcagatgtctttcccagaaaatgttaaaacaaaatttgtcttaccagtctgggaaagttggcttctgtgggcattatgaaagctggaattgctttgatgtgattctgaatccaaatggccttttaatctaagcctctctatcatctccatctatgtgtttgtaataaatacatcaatttatgtgggatacattctttttatactcattatttcttccttttcttgtcaccatcaccccttgaaaatttcttttttttaattgtcaatttactctaaaagcacctggatctggtcataggaaggttgaattgctctcctactcaagaaacaaagcacacatcctctgatactgatgtatttactatttatatttttttctcttagtgtttctgattttgagagaaagaactatcatcctcctaaaatgctcgtaatagtaatagctttatatgttgaaaagtttgcattactgtagtcatggttttttacagctaaaatgcctatattggttcttctttaatgtttatgacagacaacatgattggacacttgtaatgtgccacacattgttttaagagttttacatgtattaattcctttactcatcatagtaaccttattggttaggaaatactgttattcccattttaaagataatgtcactgagacacggagaggctaagttacctgcccaaggccgtaagcaaataggggaattaggattaaattaaaatccacagactggttcttgattacttctctactctatttcttgaattacccattccttcttgtgaaaatgcagcttaatttgatgaatacttcttatctagacttcagaggtatagtaagttaaatactatctaatgaatattgaacctggactcagtattattgtactattaccttattctattggctaaaataagtattccaaaagtacatcagctaagaagctgtgaaactcatttctcttatacataatttatctcttcatatgtttaacgattacaattatgtccaaatattatgtgatagactgaattatctctttttgcatctctgccctacccttgccaacatagcccatttttaaggtccagttattttattaatttagtaagaatgcatgctaattatgatttatacatatcaataataaaattatgaagatgatattaaggttagatttaatattttactattttcctatgtatattatattcatttggtcttcttacaaacctcccctatggtcctagttattatcttgatcattttgtgagtgaaggagctgagaaacaaggaggaaagtgatgtgccccaaactaatatttggctaaggatagatttgcactgggtacttttacagctagttctgggtcatttccacaaaagcattacttggctggagtaaaactataaacccaattgtattaggcaccaagcagatccagatagaattatcctgttccagagtttcatcttttatgatgattgtggagatcttgggtgactttacaaaataagaaacttttaaaaactggcaatagataggatcatttaatatgaggataaagaatctaaaggatagccttaaaaatgtgatttataatcatgaaggtttttatacggaggaaaatataattgcatttaaaatttccctagtaaaggaaattacctgctctagaagctgttaactgctagactgttggtttaaaatttcaagggacagagaggtagatcaggaaggacatggactttggagctgggcaaccaggattgcattgccagatcatggggcaagtagtaacttgtcccatcctcctcttcctcgttggtcaaatagaaatattgatacctactcagaagttattgggtggtggtcaggcaagagggaatctttagcacagtgtctagaatgttccaagtgcctagtaattcttggctcaggttctccccttgggtagtttgaggactggaaatccaggcaatattgagattattaataaagatttcaagtcaagccctcaagaacacaagtcacagaccccaaaacttttggagttagcagggtttctttaattaaagagtcctagtaatatgttggtaagggggatgggagctgtggcagatgtgtgtgacataattttgttgcaaatgcaaattagttttcctgtcatttgctagcaagcccactgtttataataactgttcataatgaatcaggctgatattttcttcatacattttccctcaaggccctaataactctgcttctatgttttatggttacacattgtggaatgagactctggtggaaatgcagtcccattttatagcctttgtagaaatgagaggcagagaagaaaagcaaaggaagcaaattagtggtcagaaagggttccaagacagcaatgtgtgttcttcaagccaggcctggagggtatatgaggaagataaagggtggtccagaaagcctccatcagtgaagtagttgaacagaattaaaactatagcaaaggttcttggacttggttagaaggaaaccctgagcgacctgaactaaatgagttctgtccaattcagcaaatacttactaatacctactatgtcccagatcctttatagccttacagctgtaccatccaacatagtagtcattagccacatgtgcctattggaatttaaattaccgaaaattaaataaaattaaaaactcaattcctcagttgctctatttctcaagttctcaagccacaaaacatagtgtgtaatgactactatattagatggcatagaagaatatttttttttatgacagaaagttctcttggacaattgtgccctagaagtatgaggatgaccaatatttgactcctgcccttgaggaatttatggtcttagaaggcagaggaacatgtaaggaaggaagaaagttagtggggctgtgacagaagtatgtcagcacactgttgtgggaactgaggatagggtgatgaggcctaaaagagacagtggtcaaatatagtaggatgaaggaagaacagcttttcaaaaaggctatgtagagggtggaacatgatcagagtcttaaaagatatgtagttttacctcaggtggaaaagggtggaaaaaggcattataagcaaaagtagaagtgcgaaccaagaagggagatgcagtgtggagcgttgggagaaatgcccctgttgtagcctggctggagtgtgctgccagagctaagccccaagaggcaggtgggccaggctgggtgtttgggcaccacaccaggggtcaagacttgtcttctgggctgtgagaaatcagcgaatggttttaaacaagagaatgaattttgtgatcagatttctatgaatgggaatggaaaaagctaggagtttgtttccaatgggatgcactgcacattttactgtgtcttcggtcaggttatttaacccctgtgagtctcagttttctcatgtataaaatgagacttatctccatctcataggaatgatatgtggataaaataacataatgtaggtaaagcagccagtacagttcctggcacatagcaggtggccaaagagtcttagatccttttccttttggccttactgtggcaagggaaacaaaaatgagtgaggtttatctgtacccccggggagcttagagcagggagtgggcctgtgtggatgagtaaaacaaggacacaagtaactatgtccacaccctacacacaccccaaacatacatacacacacacaaccatactaacacctaacacatatgcacacacacacacataatttctcctgcccagggagatagtctaagctatgagtgagaggactggcatcaactaacctgtgggacagtttgttcctgcttcattttcaatgaaagaatgagtgcttaaaagcagagaattgatggaaccggagaagatgatgttgccacagggcaggaaagaaaagatggtctccggtgtggtcatgaagtagcaagagatggggcctataggtaaccacccctcaacctccctcctctccaacaggctgccctgggactccctggctgggaggcaacataatgagagggcacagtgggatggggttcagagtgagggcatgaggattaagtctaagatatggagcactggctgtggagttagttagatttcctatttatcgacataaaaagccatctatattcagattttataccaaatcctgcttcttttctatagtcataatcttccttccatttttagtttccaacatttcctattttctgttaacaatcgaaaactgtatgtagtacacaagaagcctagttctcattgtaaatttatagcaatgtttcccaattgaaaactctcaactagaacatggcaggtggaaataaaagtgaaaggcacagcaccgttagtatttttttttttcaaaaacaaactttggcttaagttctattaagttagagtggtgacaatggttatgtcctattgatctaaagctccaagtagcatttatctcctgttaataaaacactgaaaaactaattgtcaatatgtgcagtttgatgcataatctttcaaaatacttggtccattgagaatgaattaagaaggacactaggaggtgaacacactgtttatcactggctcctatcaggactattgtgatatgtggaagggtaaaaccaaccacatcaccttttctttaagattgtcaagaggcagttacagtcatatacattttctcttgatttttaatgtagacatcaaagtatgtatagatcagtaattcttttttctatttctatgtgttccttagaaatgtaattggagagatggcattgtgtaagattgcatactagtctggcaattatttgtcatgagaaatgtattaagaatgatggataattttaaggtccataaaaaatatgaggcctgttgtagtcctagaattccagagctaaattttcttcaagtcaaattagtattttgtttctgtttcttcttttggtgcagttgaggtatcctaataaatattcggcttagagcattccacttaaaatttttaatctttgtagatttatagtattgcgattccactgtcaaaatgacagatactgatatgtattttaaggtaatcttatatgattatttttcagtgcactgtatcagtcaatgccctgacaggtcataaaatgttacagctcataaagaaccagtatatactcaattttcaaggtacagcagaagaactataaattaaattgattacataactataaaataattagtccagtatttccagacaactttttaaaagaacttccctgccacagatcactgtttgaaaaggaactggtccctattaagtctgtccagttttgtacactgtgcttgagtttttttctcttttactttacatcccagtagctcccctctacttccttcctcaaggtgagctcgttccctccttgggcttcaactaactcctatatgtaggagtttctaaatttatatctcctccccagacatctcttccaatacatagattcaatgcttccatgcctattaggtatgtcttggatgggatttccccacaagcagaccttgagacaagggtttgagtgcaagtacttaatttgggaaagtgtcccataggccctggtaggggagggaagatgtgatatgggaatcaggagttcgtcgtgaggcagatttccactggggggccactgaagttcagtcctgatggggagctctgggagacaggacacaagacaccttagaattaacctcccccagagggatcctccagagggctggggagtggggtcattgatcctccagctccatctgtcattgcctgaagactgcttttgcaggtgttaaatggtcactctttccttcggatgtccctcccacaaaaaggagcaaaagccttcaggtggaaagttgcaggtgtatgtactgacaaggtgaggccaaagggatataggtgaggacagggcactgcagtgtctgagagtgacacttccacctgagtgtacacagattcatcaagctctgcatatccagccctagctccccaaacttgtttttcctctacatcctggagaatgcgctacagtgtactccttgatccaggcaggaacccctctccatccccctacttcctctcacggatgaaattctatcaatttcatctcttcaaagatccttactctgttcacttttttctctcaccacactggaaatccagtattttccccacacttttctgtattagcctcttgactttctctctgccttgagtcacaccaacctataatctttcctatagacagagtgagggttccaaactgaaaatctgaccatgttcattctctgcttaaagtcattgatgatagcacagggtactgcatgtgaggtccttcatggttttatatcatcccgtatcactattcccacctcaccatatactgtgcatgccaccctgggtctttgtgtaggctccacctggtcctggctcatcaccatagctcaggtgtcacctcctgagggtgtcctttcctgactcctcaccttccccatcccaagctgtgcagctgccccaaatgtggctttgcttgctcacatttcttagcataccacagtgttattgcctccttctttgactatctcttcaactcagctgttaagttctctgaaggcagtgactctatattaatgtcaaatttttagcacctagcacaatacctgttcataataggtgctcaataaatatttgctgaaccaatttgcctatataagcctctgtaatccttaaagcagtcctataaggtaggtattactggctttacaggcaaaaattttgaggtcaggtaggccaaacatcttgctcaagatcgcagacctaataaatgatcaaatcaggatttgaactcaaatccgtctcccaagtccatattctttccattaaatcatgttaatttttacattgtaatgctctagatacttcttctatttcactgtttatgaaattaaatggccttaatctttttatttttctagaaataaatgtgttcacaggtggcatctagaaattcaataaatattcagtctccaggaatatgagccctgcaaggtttggtgtggagcctgctgagaagagcctatgactttctagtggaatttttatgctttgggttagatcatgggaatgaatatccatggttagtttgtgatgcatctaagctgtggaatttcaatgagtatccatcagtttgacagtcaaaaggatatatatgagggccttgggggtgggcagggtgaagcaatttggaaatataagcagtaaattttcacacatcactgattgtgacagtgaaatgattatccatcaattacaaagcagttaagtagatatgtttctgggtttttactgcactgtttatgtatccagttctcctggaagagttgctcctgcatcatagtccatgctggacagcctgcatcagtttcagtgcctgttggagacacagagagactattggatttaggaacaaataaaaggcaaaaaagaagagatgatactgaaagactgttacttttcaaataaatcatgtacctgggaaattataaggaaacaatttccccaaataaaaccatgtcagtctaacaaaaggttatttttttagtgttgcataacataaaagaaaatgccaatttacttatataaaaaagttattaagttgtttataaattcaaagttgcaaagtacatttctttacatccatgtaagttctgggtccattggatccctgataaaaaatataagaattggaaaattcaaataagaatttaggggaagaataaatgacaaaataaatgtgagacacttagagtagtatctgggatatagtaaatagtcaataaatgtttgctatgattattattcacattattataagaaatacaattgctgaatgagatcttgttcttctgtcatgctgacattaatcagagttcagctattagcaatttcacacacatacacaaacatacacacacacacacactccactgactcttcctatgaggctgaaattaaaattcgtgatttatcagatacaataccatcctcaacgaacacagcagatacaaatgacaagtagaatatagcaaagactactcctacacatatgggccttcttacaatacttgtttcagaggtatttgcttgaagttatcctttagtttaaatctttgcattagtctgatatcaacaaaatatcataggatcctttctgttaaccagctctgtcggtggaaaaaaaatatttcatattaaattggagacaggaagtactaacaaacattcatgtgatttctcaaatacacattggaatttaggaggtgattaattaatctttagtcctaatgggctggacctgtagttcaaatatttaattctaagttctaagaatgaacgatatctccctgttgagccaaaaaagataattagtagaaaagaaagcaagcaataacacatacctaccagttttaaaacatatagctcaatatcttagtcaaatatattgccaaagatcatgttttatggggaaaagaaaaacaaaacaatattacatacccctaaacttgtaaagccacaagaaaatatgtcattaaagaatcatctttatcatatggaaatattgcttgatgatatctgctcattccaaattgacctgacagatcatctgaaagtgtacgaagaggttgttggcgagactgtctgaccagttgattttgcatgtcaactcatgacacaagggagaggcgatgaagataatctatagagattttctataagagacagttatatatttggtttgatatgcacatcataggccttcaagcttgctcccatatcagtgctggaaaatcctgccctttaagaaacaaactggtgatttttaaaaatttagatgcagtattactattattattttggtatacacatctatgagttttgacacatgcatagattcaggtaaccaccaccacaacaggtatatagaacaattccatacactctccaaaatttcctcatgctgcctcttatagtcaaatcatcccctaaccccaatgccttctatgaaaagacatataaatgaaattattcagcatgtaacttttagagactggcttgtttcacttaaaataatgcttttgagagtcattcacattgttgcatacaccaattgtttgtgcctttatattgtcgtattccatcgtatggttgtaccatacaatttcaatagatttgttaatctagtctccaatttaagggtattttagttgtttccagcatttaactacagatatagacattcatgtacaggtttttatgtagacataagttttctttttcttcttcttcttcttcttttttttttttaattttgagaccgagtattgctctgtcacccaggctggagtgtagtgctgcgatctcagctcatgacaacttctgcctctgggttcaggcaattctcctgcctcagccttctgagtagctgggattacaggtgtgtgccaccacacctggctaatttttatatttttagtagagccagggcttcaccatgttggccaggctggtctcgaactcctgaccttaagtgatctgcctgccctggcctcccaaatgttttcatttctaaataactaagttatttacccttggggcactctgaaaactgccaaaccattttccagagtgattggaccatgtacttctaccagcagcatatgagagatccaactctgccacatccctgcacttggcatgaccagtctcttttagtttagtcattctaatagatgccctgtcttttttttatatactttaagttttagggtacatgtgcacaatgcacaggttagttacatatgtatacatgtgccatgttggtgtgctgcacccattaactcgtcatttaacattaggtatacctcctaatgctatccctccccactcccccccagtccacaacaggccctggtgtgggatgttccccttcctgtgtccatgtgttctcattgttcaatttccacctatgagtaagaacatgtggtgattggttttttatccttgcgatagtttgctgagaatgatggtttccagcttcatccatgtccctataaaggacatgaactcatcattttttatggctgcatagtattccatggtgtatatgtgccacattttcttaatccagtctatccttgttggaaatttgggttggttccaagtctttgctattgtgaatagtgccgcaataagcatacgtgtgcatgtgtctttatagcagcatgatttatagtcctttggatatatacccagtaatgggatggctgcgtcaaatggtatttctagttctagatccctgaggaatcgccacactgacttccacaatggttgaactagtttacagtcccaccaacactgtaaaagtgtttctatttctccacatgctctccagcacctgttgtttcttgacttttcaatgatcaccattctaagtggtgtgagaaggtatcttattgtggttttgatttgcatttctctgatggccagtgatgatgagcattttttcatgtgtcttttggctgcataaatgtcttcttttgagaagtgtctgttcatatccttcgctcactttttgatggagttgtttgtttttttcttgtaaatttgtttgagttcattgtagattctggatattagccctttgtcagatgagtagattgcaaaaattttctcccattctgtaggtcgcctgttcactccgatggtagtttcttttgctgtgcagaagctctttattttaattagatcccatttgtaaattttggcttttgttgccatttgttttggtgttttagtcatgaagtcctagcccatgcctatgtcctgaatggtattgcctaggttttcttctagggttttatggttttaggtctaacatttaagtttttaatccatcttgaattaatttttgtataaggtgtaaggaagggatccagtttcagctttctacatatggctagccagttttcccagctccatttattaaatagggaatcatttccccatttcttgtttttatcaggtttgtcaaagatcagatggttgtagacgtgtggtattatttctgagggctgtgttcttttccattggtctatatctctgttttggtacagtaccgtgctgttttggttactgtagccttgtagtatagtttgaagtcagataatgtgatgcctccagctttgttcttttggcttaggattgacttggcaatgcaggctcttttttgattccatgtgaactttaaagtagttttttccaattctgtgaagaaagtcattggtagcttgatggggatggcattgaatctataaattaccttgggcagtatggccattttcacgatattgattctttatacccatgagcatggaatgttcttccatttgtttgtatcctcttttatttcattgagcagatgcaaggctggttcaacatacgcaaatcaataaacgtaatccagcatataaacagaaccaatgaagaaaaccatgattatctcaacagatgcagaaaaggcctttgacaaaattcaacaacacttcatactaaaaactctcaataaattaggtattgatgggatgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaggaaataaagcacattcaattaggaaaagaggaggtcaaattgtccttgtttgcagatgacatgattgtatatccagaaaaccccattgtctcagcccaaaactccctaagctgataggcaacttcagcaaagtctcaggatacaaaatcaatgtgcaaaaatcccaagcattcttatacaccaataacacacaaacagagcgccaaatcacgagtgaactcccattcacaattgcttcaaagagaataaaatacctaggaatccagcttacaagggacatgatgtcctgtcttctaatcatgtttctgtcctctgtaccattagggaccaccagtggcaactttccacccaaattgttccaccaagaaatctttgaacatgttctccaatttataatattagccctgtttcaatccaaaatagtgtgtggtggcatgagatactcctaaagactatcaagcattgtaaaatcattatcttcttcgtctgaagacatccagaatatttctcattgttagtaattaagccctgctactgtgtaaatgagctttcatctttgtttaccatgggtctgcctgaaaaatgtcaaagaacactcaataaaactttccatgtccttcaatcttaacttcattatgacttgtgatgaagtaagagcatggttccttcctttctagaaatcttgcattcaacaaatatttgctgagttccctttgtgccaggaacttttctagatgctggggatacggcagtgaacaaagcagacacaaatgcttgcctttacaatcctaaaaatttgggagtggatcaggcaatagaaaatacataattgaaataggtaatatttcaaatgcaaagtgttataaacaataaagcagggaaagaggttacaaccttaaatagtggggacaaggaaagcttcagtgagaaggtgatgcttgagtaaaaggtgatgtcaaaccctgcagaaacctctgtaattgtgttgccggcagaggaaacaagtgtacaggctttgatgtaggaccgtctacgtcatgagtgaagagcggtaaagtgccagggtgtctggtggacagagtgaataagaacatggtataagatgaggttatgactatattgtgtagaaccttataagccactttaatgattttgggttttgttctagacgggaaaccattggaaggccttgagaagagaagtgatgtgataggacctactctatcttctatgcagtgcatagacttggggccaagggtagattcagaaagactagtttagagactgttatagtaatccaagcaagagataatagtggcttgaatcaggctggtacccagtggaaacatgaatccagccaagctgaaggaataccttttatgtgaacattctgataatatattggatgctatggtttttaagacattttccacatgctggaatattaccaatgtttggatctcaccaaatacaaaaggctgtgcttgaggaatctgtatcatccatgctgaaattctaagtgaaagaagctatgtcactaatataatcttgaattcacatacactggaaaatgtgacatctatagcttataactgaggaagaaacctaaaatgtggtgcctcaagcagatgacacaatccatcaccattaatgaggacatttctcctaacattttgtagccaataatgtaaatattcataggttccatggccatttacagcagactgatgaaacaaccaaatgaagccatctccaggttttcatctgttttgtgcatggctattccatcaaagaattactatattatgagcccctttcagaaactacaaaggcctttgacatgttcaaatgatgaaaattgtctttgccaagcataacatcattagaattaaaaaaaaaaaaaaaaaccttggtgttctttactcaaatggcagcactgtgatgcttggtcacacatctgatttttgctattttggtaaataaagaaactccttgttttcacatcagcaagcactgctgttagtccctgtcagcaggcttgaaagaaatattgtccaaggtcagaagcatcaccttctcttcagaaccacttttataagaagtttcattaagaagtgggaacagaatgtgaagtttttctccttacatagaagatctctgattttctaccaaacttcttgaaacatgaaactgcatttcaggcagcagcttcagttaagaaaaaagttcccttgggtaatagtttgatagatgtgccttcatgcattgacttatttaacagatgttttaagtccatggtattcaaaattagggtatacaacaatttttcaaggagtgtgagggcacgttggaatttaatagataaaacttcttaaaatttcagcttcctgttaaacttttctctagaagtaatctgcctgagagtgtatttcagattatttctcctttttcacttattctttcattactgcttttgtccactgaaaagaagatatagctctcatccactcaaaatttaatgtgttgcatttcccaaggtgcaaaacgtctaagatataaaatacaatgatgattttgagaaaggtagtaattctaataaccaggaattattagaattattagaataattctaataaccaggaattattttacaagtcagttttcaattattagtttttaataaagttgaagaggacctaatcaactctcagttgctagatcattaaatatactgtttgatgacagacaatgactttaagaggataactaggaaggattttagagacttgagcaacattactactgttcaatctcatctacatatgtatataaataagttttctagggcttattaaaattggtaaataagaatagaatagatggaaaaccctctctcattttaagaggtaatactcattcaaagatagatgaactaacagaaaaatgatgtgatttttctcattaaatgatgcaattccaataaaaataattttatctctaataattatcaaaattcaatttatattgtttcaagaatcaattttatatactacatataattatgattattaaaactagaggaaattttaaatactgaaagtttatagccataagaaataaattctaaaaatgcattcacattttatgtagagaaataaaattgagtaatcaataaaagacttttatgcataaaaattacaataaattcagatagaattctataaagtaaaatgtcaagtttctcatctgttcactcatatgtccacctttattctaaatctttcagcatttttatcagttattttcacctctctcttggaaaactccagcctccaggccatcctggagtctgtttctattgactgtttcctctcttggcatgagtcacatttttttgcttttctgtgtgcattataatttgggggggcgcagagaatgttttgtgtaagagatcagtagaaactgaagaaaataaaatttcttccaaaaagtaaaacattcctttttctagagtaggaacctaggcaatttgaaccatatttgaatactcagggcttttttgcactggtggttttacttggttcaccactgttttcaaatattttgaggatatgatcaacttctctttcaacagagcctggtatcagagcattggaaagattccagagactttcctgagttttagagttcagctgccaaattttggaactgtgggtgatatctgcctgcttacggcccagctggcatgattttgagtccctggagtgttttctttgctatctcaccctccccttgctttctgcacttggggagacatctttaagcctaatggtccctttcctagcttttgaagtgctgccgccttactgccctatgctctctgaagacctggaatgtcctggaagggtttctcttagcagttgaaagcttagagtgcctctctcaactcccctgctgtgtgccccgccaacactcctcaccttttgaaggggatttgactttgggcaaataccttaaagaaaaactctttctcagcttttcttgtctggtccccttactttgggcaaattacccctcatactgtgacctacttaagacctgtgagtgaaagttggcaggtagatgcatggtcacagggtcatgggattcctgagggtaccatccatcaagccagctcacacagggctgttcagtagttgttaagtgttgggctagcttctttctacccccatctgtgggaggagccataggtctttcctcttccctgaagggtttgccactttctcgagcttcgtttacctagacatctttataactgatctggctttttgtagcctattttattatctatttatttatttaaactttttgcttgttagggtgggagtgatgatcttttgctactttctgtatctaaaccaaaagtcctgttcaaatatgtattaaaactgatgattgtggttatcaaatcatttggcatttagattccattagtttcacctaaaaatgacattttgatttgattttaaaatatttatataaacactatgtcaagaattatatccttcagaactgtttaagcttatgatgaaaaattttagatgtcaacttaaaaatatgtaagggaatatatatagttcttcattattctattgggagtacatgagtgaactcaggaataatagcaaaggtaatctttttattctttcttgattagggcagtgtgggtgactggctttgctttgcttcacactgtgggtcttctgggctcagttccaatcccctttctgcagcctggagtggaacagagggttcaagaccttgtcagcttctcactagacagaaatttcaggcattttgactaatctagaactcttttaaagaacagatcttagaagctaacacgttaattttgtaattttcatcttaaagatgtataattttaaatatccctgatttagataaagctaagtttcaatttctaactcaaatataatccattttagaattcagaattgctcctggaaaaaagaaattgttacagcaaattttgctttactaagtcagcagtgtgaaatattctgatccaaaataaacactgtctgacatatagtgcaggaaatatctttacatttttagtatatcacctataatacaatatttactcaattttctttttttaaaaccaaagttttcattacataacatttaatgcaaccagattttaaaggttatagaaccgctttttattactcagacaaagaagaaaggtaacaacttttagaaagattgttgactttgccatttgataatgaacagcaatttagcagaattatttgcaagtaaattttggctatattgtttattttattttagaatgcttcacatggtgccaaatgactagacagtccacagtagaaaaagttattacttcttttagtctttattaattcaagacataattatttgggatgaaaatagaataaaatttttctttttttaatacccattgtttataatgtaaattagttatgtaaccataattaatggagaactaaaaactaacttaaatgaaatagtttttaatcctcaaaacactttggaggtaaccagacaaacaattacaatgctcaactataaatgtcttgttttttttcagtaaagcaatttattctgtgccaaccgctgtgccaggccctttacaagatcactcttatttcaccctcataatacgctatgaaataagcttccttttatctacattctggagatgagaaggctgagtttagaggggtcaggcaacttgtctaagacataactagtaagttgcatagcaagggtttaaactcagacctaatttcaatatacttaaccatactccttctccagtgtattttatgtattgagtagtcacattctaagacacctagtattaaatgttgttcttgacatacatacattttaattagttatttctgcaaagtcataaaacactccaaactcaatgctttcaacaatcagcatctatttttcttgatcgtaggagtgtaggaaagccagggagaccctgtttcaagttgctggtcagctgggcttggcttcaggcttagaactgggttcacatctgctctatgtgtcaccatgttcttcttgggccagcatctccctaaggcatgttcttttgatggcaaatcacaagagggcaagcagacaatccaaaccatgcagccttgcctaatatttcttgtatcacagtccattaaccaaaggaaatcacaggaccaagtcccaagtcactggagcagggaagtatatgtcatctggaagagaaagaagggagaatgaagaaagtatttctaacacaaattcaatctatcacatattacttggacaatgctatagattgaatgttttcctttgttatcaatattgcacatgcttaatctgcacgtcagtgtgtatatatatctcagatctatacagaatataaacagaggcatattataaattatcaagtagtgtttctgtttttatggataatatttgaatgttgatagtaatttttaaattaaaaaatgggtttctattatttggaggaataactctaataaggcttaaaattattttaaaacaagataggttacttagtaacaaacatacacaaatataaaaattaaattgtattggctaggcgcagtggctcatgcctgtaatccaggcactttgggaggctggggcgggcagatcacctgaggtcaggagttcgagaccagcctgaccaacatgtctctactaaaagtacaaaattagccaggcatgatggcgcatgcttgtaatcccagctactcagaaggctgaggcaggagaatcgcttgaacccagggggcggaggttgcggtgagccgagatcgtgatattgcactccagccagggcgacaatagggaaactccatctcaaaaaaaaaaaaaaaaattaagttgtatcttggtttctaataccattccccagtaaaggagaaaagtatgaaaacagtggagaaacctgacaaacactacctcaactagttcatcaaagttaatataaacagcaatgagtcatattgggggtatttactcttaacatgatgaacaaagtggcacttcatgtctgttgatctttctccccaaacacacaatcccagtctaatcatgagataaacatcagacacatcccagttgagagacatttgacaaaatacctgactagtacttttcaaaactgtcaaggtcctcaatagcaaggaaagtctaataaactgtcacagtcaagaggagcctaaataaacatggtaactaaatgtaaactggtatcttggatagaattctggaatagaaaaagttcattaactaaaagctaagaaagtctgaatgaagtatgtactatagctaataggaatgtgtccttactggtttataaattgtgacaaacgtatcatactaatattaagatgttaacagtagggaaattgggtatgggagttatgggaactctgtactgtcttcacaattttctgtaaatatagaactattctaaaataaaagttttacttaagaaaaatgttggctgggcacggtggcacacgcctgtaatcccagcactttgggaggctgaggcgcattcaagaccagcctggccaagatggtgaaaccccatctctactaaaaattcaaaaattagctgggcgtggtggtgggtgcctgtaatcccagctactggggaggctgaggcagagaattgcttgaactcgggagggagaggttgcagtgagccaagatcgtgacactgcactccagcctgggtgacagagcaagactctgtctcaaaaaaaaaaaaaaaagaaaaatgctaaatcgcagtgacataaagaaattaaaagccaaagccaaatactagaaaaaaaaatttttaagaaagaaaattgcattgatactaaatattgtggcacttcgggaaaccaatcaacgctaaaaacgatatgactattgttatcttagtctcactgtgatcattaatatttgacctttaaacatttagagctgggcatcctgaaggaattgccctaggactccccaaggcagagccaggaaggttcaaatgttagtcttaatggaagagaagctcagtttttttttacagcagtgtctctctttctctctctctctctctctctctctcactcactcattcactcacaccctcatgctcatttgtgaggtaccaccgatcctcactgtggtttctgttctctcctactgcttctgagtccttatatctcaccctcacctattttattctccctgatggcacttctggcaaaagaaatctgtatgtattactttgtgcttctcagacaggagtgcagacaggaaagggctaagaggagggcctgggcctgaggatgtgtcttggaacatcccagggccactaagagaaagctggctaagaacatttgacaacttctccaaaaccattaatagtatggaatgaatgaaaaactccattagttggctgggcgctttcactcatgcctgtaatcccagcactttgggaggctgaagggggcagatcatttgaggtcaggagttcgagaccagcctggccaacagaaggaaaccctgtctctactaaaaatacaaaaattagctgggcatggtggcatgcacctgtagtcccagctacttgggaggctgaggcaggaaaattgcgtgaacctgggagaggaggttgtgtcaagatggtgccactgcactccagcctgggcaagagaatgagactctgtctcagaaaaaaaaaaagaaaaaagaaaaaaagaaaaaccccattagttgcatcagaaacaatgaggaataagcaccctttcaggttttttttttcttaaaaaaaaaaaaaaaaagcaatacaacattcaatgaaagatttggaaggattttgctacagccgaaactgctcccagtagcactcctccctttctctgtcctatattttactgtttctcttgagagaaatcatgacatcccatttctggttcatatggtttaggaaaaaaatgaaagcatattgtcagtcatataattgatatacagtgcttcttgacatgcctatttttaattaaaacacattttaattaaaaaaagagagcagttttaagaagagaagctttctgccagatggtgattcctaatttacctcaaatgtgttgggagccgcatgattcattttggattagcctgacttagtgcatcgtagagaataataattttgttatgaaaaataatcacccacagcaccccctttgggtgagggaaatacgtgtgtgtgggtgtggtcagtggcatttgtgggtgtgtcttacagatattcacctgggaattctaatggcataaacaagacttttttgtaaaacgttaatgtgtgcactctcaaaaaggaaatagactagtgtttcctcattaataaataaaatctgggggatatcagtttcaggtttgcaaatgcaagatgacatttgagtgccaggtgtcagggccaagaaatactgccagacaaggatccactcatagtggcagtcatgacttccaatgaatccgagtggaggaattacactgtgcctcccttattttttttccgcagcttcacatctcactggcttcatgaccagacctgaatttctcaccaactctgtcctccacaaatatatatgcttcatatgttccacatctatagacgatagtacgtgcacattgtaccataccatagtactgtaggaagtacaccagtacatatggttctacatttatgaccacagtaggagaaaacaaggtgcaccaaagggtagcagttgttcagaagactttctccttgttcagcagagtgaaactgacactgaagtattccagatcataatctcagcatgtatttaaacccaaccttaattatcgaagtcttacatttcagagaaaaaaacaaactagtattccgtggatgtgtgacttgggtgaactacttaacctctgtgagttaatttgtccaattgtggaaagaaacgataatacctgtctaccacactagttgtaaggaatgagtggaataagggctacgaaaatattttgtaatggtcagaatgtgaaatactttattaatagtgacttcagaaacttttttttagttctactggatttgaacattctatggtctgaataaaagatagtggcattgatgtcttaaaatatctcttctgaaactcaggagaaatgaggcaaaagagaaaatactccaggttttttggacctctaatgagccaacgtaattatttttaaccaagctttggggtctataatttttaatcattcacaagaagctcacaatttcctttttttgtccagattcaattcctgagttatgactggtgttaaaatagccctacaaaggagagaaggcattgtcaagaacaatcatgcctttcaaaaaaagatgtcattttattcacaatcctggtatgaaatatatcccaatttgaaaagaggaaattattcaatggattcagtgagaagattgtgctttatggtgtcttttaagaatatttcactgtttaaacactgagtttctgaccacaagtttaagaaatgacaggctcagcatacagtattcatttttagaagtttttgtaatgtagtgaaatgaaattgatttgacaagttgtaaaaacttaacaaattttagactcaatgttctttaataataataaaaactttaatcctcttgtaactcaaacttattggtgacagacaccttgtatttttcattcagtattgaatgtagcaaagataccacatacctgccatcagagaatttatcaatgatggaaattagggtgaggaagtgtagtaagaaagttaagtatctttagaagtcagatatttgatagatgtcatataaattttgaggttagttaatgttaatcttaccaaacgcagttttacttctaaatattaaaccatatttacacaaagagtataaagacatggctcattactttaccaaaatgcagttgatatgacatggctgtaatttatctatctaactcgtactttttatattagtttactttgcattggcatgatttctaaactgtttagatcttttaaatttgcatttcaaagtagctataaaatatgtattccattgcaaaacattagcataaagtgattcgatattatatattccgtcagaaatgccaggaagaattccacaaccattgcatttccatctggcagcatcttcctacactgaatatttgcataaatatttcagcaataaagtaaaattatgaaacataaactctttaggttattttccaaattgataacctcttcaaaatttaataagcaaaggagctatgcaattgcaaggaaattactatagtgctttccacctattttgaactgtcctggggaaatagttctttcttttcttcaatacatattttactcatatcttactatttctgtccataaggaatgagtattcagtggttgaaaaaatgaatttctactcaacataggtatgaatgtttaagtagtctggctgagttttccagaacattattcatcttgaatgaaagagctatgtgctgagttaatgacaggtgactgtcatagaattgggatattatagagcaagaatcttctattttatttaaatgaatgccatcttttttagtgcaaagataacattcatcctcagagctacaattttcaagattggtgatgattggtatgctaaccaaatttccagaagctcattgatttttttaccagtgatatgagacagcacctttattttcacccatgtcgtgcaagcgatgttcatagtttcacatgtatgtgaggatagatactagagaggtactttatatgctactttatttaataagctaactctttatacattaaaaagtatcttagagttccacagtggagttagaacaggatttgaatttggctctgcctcttattaattctgtgtgcaattttcttaaaacctttttaatccatttacacatcttagaagagtggtagcaatgatgccaatcattattctctgaattcagggagaaaatgtatgtcaaaaactcaccccactgcctaacatgggtaaaggttcagaaaatataaggtgtccctactacaatctgttcttatttttattatcattgtggttactaatctgcccaaactttactaaatagcttctatcaaatacagttcttatgtgtgacatgatagagaaagtgacaacctggaagtcagagcacctggatggtatctcggttcatcacctctagggtcttcgggtcggggtttgcatctctgaacctcatgttccttatgtttaaatagaagatgaagcttaaagatgatagtcaaaattccttccagtttgaactttctagaaaatgaatccttccatagctaaacagtggtgttggaagcttaaacttttaagctctatcaaaacattttagccaccttacctcttcaactctgtgaggtgggtcagtatttggtgagcacttgttctatatctgtcattgtgtaaataattctataaaatagtgcttagctctcaaggtgtaaggaggttttcagattgctgaaaatccacaggaatgctgggtacatttcatggtggctcaatagctgatatttattaagcactctgtgcttagctcctgcattttttacacatattattgtatttaatatcatctgattttagtttcacaataactctgcagttagaaaactgaaactcagagaaacaagaaagtgggaaagttgaggttaaaaacccggctccttttgacctcaaagcccacattcattccatcactgtacaatatctcatatggcataggcttaattcttggttatttaaatgaatttttgaacattttggtgaaaatttttatgcaaaaaataagagattgtatagtaaaaaagggtttgtgttgtaaatatgctaaaatttgaaatcgaggctattaaacttgacaggctgaaaatcaccagaaaatatttcaatttttttcctctgttttaattagagatgatgatgataaaataggaattggagtaaactggtcttttcctttcaatgaacttgatatttttaatatttatttttgaaaagggatggtaagactacctgatgcttttttaaaataaattttattgtgtatatttaaggtatacaaaatgatgctataagatacaaatatatagcaaaatggttactatagaggaacaaattaaggtatccatcatctcacatagttactcattttttcccctggtggcaagagcagcaataatctacccatttagcaaaatcctgaatacaatgcactattattaactatagccctcatgtagtacattgcatcttttgacttattcatcctgatgattttaagctggaatctgttgggaaaaaattgatgaatacttctaagattttttcatttaaaaaaaaccaaaatctgtaaactgtgctactctcaatagagattaagaggaattacctaatataaatatataaaaatttaaaaaatatatctgcacagtattttgaaattcattctctgggtaagaaaagcatcatgtcagctctttagagacccaagattctcagacaaccaatggaggaactaatgtatgaatttttgccttgaacagttcctgataccttcatgctcttacagttctgtagagctgaggatatacaaatttgtgatgattatgctttcaatttgcctgtggtttcccaggcaatattgcagtgtcccagtatatcagctgtgcaggtatgaatatgcctgttttgcagatgaggaagtcggtgttcagagaggtgaagtgacttactcaaattcttgggggtggaatcagactcagatctctcaaagtcaactccagtcattttccaatacctcccacttattcttgcaataatccaacacataattacttatgtttctgtgttttcaatgagttaggggaaaatggtcaacattgtgtgtccttaatagcacagttaccacatagtaactgcaggactttttagtgctaccagtctttttattttaatatttctatttaaaatttttatcttattttaaaatttttattttagtgctgcttctgtaggaatcaatgcattccatggcatacattagtaagtacaagatcaaattgcaagataagttcttgcatcgattgtgttttaatatttctcattgggttagtcctagtttatggtacagtgagtgcacagcaagacgggtagataaatcatagaccataggagctgaaggaaccttagtttgtcaaacctcttgctataacaaagtaggaaactgagacctcagatatgaagggagaggtgacaggtcacacagcttgtctagggcagagtaaggcaagaactcattcattatccctaccaatgtggaaaatgcagatcaccaccagtatattgggcaatttgaggtgctactgagatgataatttttttaatgtactggtatatttatgcatttttaaaattcttactgtagaaaaacacatggaagaataaaaggtgtttttttgtagttggccaaaccctgcttcatctgggtttcggcagccccgctgcttatggggtcattatgggaccttgtgcttcagcactggggcgtggagctgtagcaggcatcacgatgatcacacctctaatatgttttggggcatacccaggagtcccaggttcttacagctcattatctgctctatttcccatcatgctcataggtttcattcagctccttaaatataccaagtgttctcttgccccaggccctctgcatatgcgattttcactgcctgtaatcctcttacgtaggtaggttcttctcttcttttaacttcttattttgacataattgtagattcacatgcagctgtaataaataagtgatagagaaatcttgcgtatccgttacctaatttccttcaatggtaacatcttgcataactatatcacaaaatcaaaccaggaaactgacagcagtataatccagcaactttaatcggatttcaccaattttccaaactctgtgtgtgtgtgcgtgatggaattttattatgtagacttgtgtaagcaccacaataaagaaagatacagaaccattccatcacaaggctctctcatgctactctttgtagttatagtcacatctccccttttctccctcccaaaaacctggaaccacaaatgattttcctattgctataattttgttaggagatgaatattttaatagcttttttttttttactttaacatgtattgggaaaaattagccctctaaaaccatgatttcagagatattgcttgggatcaaaataacttggatatttaagtttttaaaaagtagtcaatttaaagaaacatggtgagtaaacaataattcaggtggtacacagctttcatgaaaattgtgaaggtggtagatgatgcgtttgggggacagcaaatttgaacaggatagaataaacggttaaggggaggaagaccacctgttcaaccctttttcatgctaagagtaacttttaaatgtggctaggcattccaagccaatacttccagtccagttgttagggcttagttataaaaccagctagttgcccctgtacatttgagcaagcatggtggatcaagcacaaaggaggggagggatagcattaggagatatacctaatgctaaatgatgagttaatgggtgcagcacaccaacatggcacatgtatacatatgtaacaaacctgcacgttgtgcacatgtaccctaaaacttaaagtataataataataaaattaaaaaaaaagagtttacaaacaccctggctgactctctagtacaatagaaaattaccaggtgacaggcagagtctaaaccctgaaagttttcattgaaaaagttttggttttctacttgtacttagttcttactgaatcaaggagagaaatgaggtagaattagaataactgagagattttaagttataccacaaggcatgaaaaaaacaacctgctcgttcttgaggaatctgttcaagtctacaaaacttacttgtctgtcgtatacaaaagtaaataaataaataaaaatcggggctaaaaatacatgactctttaggtctaatatattgtttgtttcattcgtcctgtgtgatactaaagaaaatacaatttttaaaaagagcttaagtacaggtattttaaaatttactttgccaaggtagcccttgtagtagtaataagaataaatttttcaaccaagatgtatttattaatatttatcttctatctggtaaactagaatggaaaatccaaagttttggtccagttgaaatgcaacatcagttccattaaacgccgccttctatcctattgtaaacaaattaggattcaataattctttgttagctacttcatttatttaatttaggataaattttactagtttaacagtgaattcaaagttacaaattgtttcatttcctagtgaagtgcaaattgcatttcatgaaaacgaactgttaccactagagttattttaaatttttgttttcatttcccatgaagttctaaacaataacaacaaaattgaatgaaaaattgttactcactgacttataagactaaaaacaaatctgttatttcagctagattcactccataatttcactacattctaagaaataaatttagtcagcttttactgaaaatgcacaatggaaatggcttgtgctagacttagtgtaatcttctaattctggctcttaatataaaagaacaattttgtgtttgagaatcttactgcatcctaattagacacatcatgatactatatatctagaagctatatctgtaatatttatcactgcattaattcataggaatttccccctgaatattataaagagaggcagtacatattcttttagaaaaatgtgtctgaagtttctcaatggttattttgggaaagaagaaagcttcatttcatgctctaaattttataaactggatttctataacattcttcttattggaattttgaagaatgtagagtgattattctcctgaggaaagagtatgggtgaaaatggctggatggagatttaaaattacatcgaagaaggactgatgatgcctgagtaactcttatttccaaatctgactggcaggaaaaggagagaaactacactaagagaactaggagggttagcatttttttaaactttatgcatggtaagtacaatagctacttataagaaagaaacatagcatttgtttcacatcgaggactagatctgtgttagatagaaaaaggcaaataacactgtattttgattcttcatggcagtattaaaagaaaagaaccgcagaaagcaatgattattttggaaagatttcttgccttttccaacctgttaagatgctaaatgtacacatattgacaagtctgaatccattgcctcccatagatattctaaacttttggctgtatttattgacgaagcattttccagggcagctagaaggtttgccactgctgtactcagcttataggtaaagagagactttgagtcacatcaacagccctctggagttgtcataccttgcagacattacaacaattcaggctggataggacagctagatgcttttttacatacacaggcacacatgcacacacacatacaaacctccctccccctacaccaccaaatataccaaaaaagagtttaaagaaatgagcaaaacttccaaaatgataaaagggacctaacaatgtactccctgaaagtctgtcagagggcagaaaccaatgacactcatcccaatgcagcatctctcttgcattgaaccccccaacgctgttactgtgtcagagcaaaaacaaggaaattactagatcaaaacagccagggatgaggacatttatctaaatatttggtgcacaaggtgacatcatataagatcagatagctatgtactcagaaatctgaaaattgatttcctcagatgcatgaaatagaaacttgataagcatctattgtggttctggtactatgtatttatcctggattcaaaattatattctatttcttggagaaagagtttcttcccttaataatattgattcctcctggcccctcctctctttaccccttcaccccaccccatcaaaaccccctccctgtggttaccaagtctctgccattttctacgttactattttgttcctggcgaggctaaatttgacctggacaatttaaattgaaatttccttatggggttataaactctagtgagttaggatactattgtttttactaaagtcattataaaatcatttttttcactgctttattttagaaattagaagtagtttaattcaaaaatctttaatgaaggctgattctgttcataagaaaaattctttatagcagcatgatttatagtcatttgggtatatacccagtaatgggatggctgggtcaaatggtatttctagttctagatccctgaggtatcaccacactgtcttccacaatggttgaactagtttacagtcccaccaatacctaatgctagatgacgagttagtgggtgcagtgcaccagcatggcacatgtatacatatgtaactaacctgcacaatgtgcacatgtaccctaaaacttaaagtataataaaaaaaaaaagaaaaaagaaaaattcttcttagggttaagttgttatcgttcaatcctatgctacaccttgaatatactattttaggcaaggaaaatatcaaacatagtctagtataacatgtgcccattttggccatgcctatctgtcttctttctgtaatgagaccatatatttcctcagaatgataggttgtgctcgggctttgatggggatttttgttttattttggaggatggtagtgtgttatttagcaagtccctatttctacctctttagtgagggtggtagacagagaaacctgaaaaaactttgattttgttgttagcgtctaaattacccattttagtatggaagaaaatagtcatgagaacatcctgagcttaactactcctaattaactaattagacatttctgacagtggaatcaaatttcttgaaccattaacaacttttaaaaatgtgtgccagggtctgaaagagttaagcatccaaagatgcctaatttactctcttagagtagtttaggccctgggaggtttttgactcattcttgttttcactttctgtctgaaggagcaattcacatggaggcagacagatagaacagagctttcattatagcagaaacatgcactgtgagccccttttatgccttgcagaggccatgcaaaagagagagcagttctaaattatacttctcacaatgcttcccaaagagaacatggcaaatgaattcaattcttttaaactaaattgaatatccaaaggaaaataaatccgaacaaccaacctagttttatgtgttccattcccataatttcactacactcccattacttgaatttggttagatcaaatttaagataaaacaccttaacacaaatttgtagaatgagttttaagagagagaaagtgacttgtttcagcatggagagatagctttcctgtaattgaatatcacttgtattcatcatgtttcgctgtctagcaatgtggggtttttgtttttaaaataaacctaagagaatctaagttcaggagagagaccccacagaatttactaggatttacatatatgcaaatatggagacacagaagagactaaggagaaagtgcccttttctgatgtatttcaagataataattgaaattctttggtgatatgtatctttcaagtaatgagcttggcacaaaatcagcctgggtgcacacacacatgtacaaatgcacacagactggaaaatcagtgaagacagactcaggtaagttctatcaatgagaggacaggaactcttgcctcttcaaatagattgtttcagaggaaaaattactgtgtagactagaaggactcaaatacctaatcaaagatcatgaatgaattctgataggggattttctgaaacaaaggtcctttattcatcctgtttttagagtcaccatatttacttcattggagcttttttcttcatcatatcaatatgcacaaatcctcataagaaggagtaaaatagtacttatttatttattgaagcaagaaacatttattgagaatttatgaagcaccaggttctatcccggatatctgatgagaacatggataaatataacacagccactccccttggagtcttaccatctagcaggactacaagatatgatgaactggggaataaatgcaggaagtgccatgagggatgatatacagaaagtcctgggagctcaggctaaagaacagctgattctgcccccaaggggcacacagaggggaaagctgtagatatgagaaggtaagggtggtgatatttaaaccaaactttgaaggatgaaacttggcatctgtggaatgttggtatgtgaatagcagtcaaaagacaaaattagaaggcacttggtttagtgcaaaaccaggagccagcaatggctgtcatggaagcaaactcaaagccctaaagagagggaggtaagaagggtagggaaggccagcagtcacagggtcagatgagaaatttctgctggacatgcctggctgctccagtgtcttcgattatccccagcacctactgtaatcattcccaacccgaggggctctcataaaggtagacaggggtatctggccagtccccagaaccacagcaggaaaaggcaatccaggcagagaaaacagcctaagtaaaggctaaactctgcagtataattgggaaatggcaagagatatttgtggcttgagtgtgaagcatgagcatgaactataacaccatggcctcacctgttgggagattatgcctctgacaggattacctactctgcacagcaggtgctgcaggggctggtgggaaagccaaggccttaacacagtctctgcacttcccaaaaagagccacactgctactgataaaactgcttcaatgagaacttggttgactattaagcttctcaaccaaagactttggagagtttcaaagatatgtgccaaaaacaaaacacaggtgcctaaaaactggacctaactacagtttgtatgtcatgtaggcttaaaattatataatccgtgaaaaatccacaaagcaacctagaaaataggtgagatgtagatgactgggacgtgcttaggctgcgcttatgagagactcccttggtaatggaaataaaaatgcaagcatggtattgtaagctaaagtgcacatggaatatcatacggtattagcatccttttttttttttttttttttttttttgagacagagtcttgctctgttgccaggctggagtgcagtgtcccagtctcagttcactgcaacctccgcctccctggttcaagcgattcccttgcctcagcctcccgagtagctgggactacaggcgcacaccaccatgcccagctaattttttgtattttattagagacagggtttcaccatgttggccaggatgatctcgatctcctgacctcgtgatccgcccaccacagcctcccaaagtgctgggattacaggcatgagccactgcgcccagcagcattcattgatttttaaaggacaaagcaaagaaaaatacaattatatgctgataggtttcacagccacataaaatggtgtgaaaattaatttttcataaaagaagtgaggattactgaccccttacatttaatgggaatctagtctttgccctgcctttctgatgggtcatatgaccttgagaaagtttcttaaccactttggattcctgagtctttattttaaaaatgaaaatactacccacatgtctacttaattaattaatgtgagaattaaaagatgtcacacagataaaagtgtttggtaaattataagatacatgttaaagataagtgttatcaaagtcgttaattttataactttaaaatttccaaaatggaatttatttctaaataaataatacattgtatgaactgggaattagagtagaacaaaaatgtcaggtggggtaaagtggggatagtaaaagaaggaagcttatgcttcaaaccaataatgaaaggactgaatgccaataatcaataatcaaaacagaaggaagctcatgctttaagccaataatcaaagggctgaatgctactctaagaaaagatcctcctgtaaaagaacaactcataaaatacctgagtaggcaagtcttatgaagagaaagcagatctagtctcatgcagttattgcaaacagcaggcctgttgtgaaaacagcgacccataggtataagttttgtgtactctcccttgtttgttagctgacagcacaaacacagaggtgacagggcagggtgggtttaataaatgacaccttagagcaaacatgtatacaaaacttttcactgccaaatagtgcatgaatggacaaatgtaaatagctggacccagaggagccctccctggttgtctaaagatgttcaatgcaaacatcataaggagcccagggaccattaagctttcactttctttcaaatttatgagcatgtagtcttacagcttagattttagcagggcatcagcagtatcttctaaatggggaatgtcatttttaaaaatttgtatttagtatactacatatagtagtattcactttttctggtgtacagttgcatgcattttatttaacatgtgcatagattcttgtaactaccactgcaaacaggaaatagaacaattctaatatcccaaagaatttccttgtgtctatcctttgttgttagactcttcccctatccctaactcctggcaatcattggtcttttctctgttcctatagtgttgccttgtccaaaatgtcatataaagggaattgttcaattatgtagtcatttgctggtttaggtttcgagctatgaaaccttacaagctattataaaagtgcatccagactaggctatcaaaagtaagctaagctcagattcagtgggagacaggattagttttggccaaccatatgctttctgttcattctttgtgacatgaggttgacaagataatgttctaataaatgctttttttttaaattaggcctttcttaagggcatcagtagctttctttcatcaatggaactaagctttattccataatcctttactgaccatttgtttttaaatcaggctatggtgtacaatgctggaaatttgtaagtaagaggcccttgtctctactctcaagaggcaagaagtgctccatcagctgctttctggtgccaggttctgctatggatttctctatcctcctcagacaatatcggggttacttttatctttatatttttaacatttgaacatgaacaatgtgccagacaccattcttgacacttgggataaaaccagcaaaacagaacagaccaaaacggaccaaaattcttgtcctcatggactttacagcccagcttgtgaagacaaataataaaccatagacataataaataaattgcatggtatgttagaaagtgaaggatgattgatatgcaaaaagataaagtagaaagagataagagagtgctacaggatgatatggttgctaaataattggcagtgtacatttttagggaaagtgacattttagcaaatatttgatagaaaggcaattagttatgaagttaccttgggaaagagtatcccatgtagaggacacagactgccaagatcctgaggtgggagcatgcccacagtttaaggaagagcaagaaggtcaccttggctgaagcagagagagcaaggggctagtagatgagattcgaaaataattaggggatggagaatgagatcacatgggaccacagtagaccattgtaaagaatctggctcttgctctgagggaaattggaaccactgcagggttttgagaagacaaaatgcttgatatgacttacattaagaaggacctttctggcaagtgtttggagaatagattgtagggggcaatgcagatgcagggaatcaactgcagtaatccaggagagagaccagggtggtacagaccatgctattcacagtgggaggagaagagttggattctggatatattttaaagtagattcagcatgattctccaagagtttgggtgtgggttgtgatttaaaaaatgtatattcaaaaatgactgcatttatttttggcccaaagaattggaagtttggaaatcccatcaaatgaaatagaaagacatgaatttatcagatttgagggaagaagatcaggacatgttgaatgtaagagagatattagacatgtgacatttgggttatatctggagtttggaagagaggtatgatctagggatacttgagacttcttggtatatagttggtgaagtcatttgactggatcagatcatctatcatgttactgtaaatagaaaaagttagagggtcaacgattagcctggagccttccaacattaaaagtaccagctgaagatacctagaaggatgacagtaaatgcaggaaaaaatccaagacaatgaggttttctggaaaccagtgaaggaggtgttatgaaggagagagtggccaactctgtcaaatggtgaatgtaaggtaaggacttactggatttagagttaggaatcatccaaattttactgaaaaggatggtgcagaattttgtagtcttggctgtgagggagaaggcagtcagtgagatttacttaaggacttctgcacagcacgggagacaattgcttatatttcagctgcacctccaaattctcaagtgtttggattattaagttgcccagtagggccatgattctggaataagtcagatctttcatgtgatacatgattagatacattttacaaagagctgctttttctccctgtgaaaccaaaccaacctcattgttcagttgggcattatgtgctcctgtatacaccattctcaaacaactgtttccctccactccacctcaattgcctgcaggaaaactggtcaggcccaggaatagctgcctctcatagagtacaggccaggatttcccccccggccatgagcctgtcattcctaacactgagcatgtgcttcaggcaggagggatcatgacctttgtgctttatccccatccatttcctctctatatactgctgtctctacacaggtggcccctgaagactggtcactttaagaaaacactccccagtaattctgcttttgcctgataaacaaagcaatccccacccctggatcagcaatgccattgccttctgctgtactggggtaactgggcccttatgaagaaagctgcatgagcaaggaagggtggttcaaagagcctcagtaacagccacttaccccatttccctctctcccttctcagttttctacttccaaatattcccaatggcaacccctttgaaaacaaatgtatacttactcttcttactctcccttgagtatgtatagttggagatgaccaaggtctgctttaggagaggttaacaaaaagaaacagacacaatagaattgttaattaaaaagtgtaaaaagtagcatcaagtgattcaaaatacaaaaattggcctaataagtaaagcattttaataagtaatagttatttttatgttgtatgtaagaaaataaaaaataatcaagaaccatgtccttaggtagtaagtaaaatttcctcttttgtaaagagcagagtgaaatatggatagaaagatgataaatgagtacagcagctgctacattggtttgaaaactagtaatgcaatagtaatgagcccaaaggatgaacccaatgggctttcacaggttgtctgatcataaaatattgaataaatatgatagccattgcccctccccaccagacagatagacatctgtgcaagtagccatctggcaggctttggtggatgaaattgtcatgctttactatcttggatttggtgagatcccaacaaaacacccaccaacccaatcactctccaaacaactatttttacaatacaagatgattatctgacatctctgctccacagatccctaacgtttagtcaggtaataccaattcattccaagtgtggtgtttgggattgtaactgacattgtcatgtgaaggtcatttgtttggtgtcagttgtccctattttgccagaaaaataaaaggatactttttgataatgataaccagttctatttttaccttgtacctggggaagaataaaagagaaaatcagaatatatctgaattcaaataggaaaaatacacagaaactcttcaacatttttaaaatgaaaattgaatttctttggacaaagcaattctaaaatagcaaactttctctttctttttctcacagtgttgcacttctggtttttcatgttactggttccaataatgtaataatagtaaaatacagattttgataacttttcaaaggaagaacatttttactgtttttttgttggcagcacatcttatcatgactttgactactttcagcttgtctcaagataagaactgcgtattagggaagctggaaacagggatttggagtttgatgcagtcttctaaatggccaataaaaataatatatgagaatgttacttttagaagtgagcacatagtagacattcaataaaaatacttcttgatttattaggttattaggaaggactttgtggcctagaatatatggatttcctagaactactgatctaggaattaaaatagcatataaatgatcaatagcaataaaatcaagacccacagagaaagaaatctttgtttctgcttcttgcatgtcaaaagagaagtttgcatcttaggacttgtgtgtagcacatagtaggtgttccatgaacatttgttaaatgaatttatagcagaaaatatttataatattctccctgtggctaccccagaggcacaactctcaattacctcaattctactgtcagagatttagaaatgctttgtggtttgattgaatgtcacctctgcaagtttgggcagcagaactggggaaacagctcccattgcaaggaattgggaagagcaatgtgaaagtgactcacgggttcaaagctcaccaaaagtcctccacttgactaattcatccctgcattatgtgggaattgatgtggccctttcccttcaggatggaatagaattgaggtagtccttatcaaatttatgtcatcagatactttcatagctaatgcctgtgtgtgcacaggattgttggggggctgttcattcattgccttggatgctcttggtttgttgataatgtttcaaaattgtttcagtgcaaaatgaagcacctaataggcttggagttaaggcatcctccacacactagctcttaaatctggtattttatttcatggcaagaattgaggctgacagtgatgccatggagcaatgcctggatcgtgctgaattcattaccatctccacaccctgaaaagagaaggaaggattggggcgggtaccagagagacggcagtcttgacagggatgtctcctgatatgaagtatagtaatataggcctgcctctattgatattgctccagagacagatattccactttcagaatattctgtaacagaaactatatgtcacaggttattacatgatattgcttcgttatggagtggtatattgaaacatgcgtttttttctgggaagtagaaattgactgtcaggggcatatgatgtgtatcaccgctaagtgtctaaaatagaacacattctattactctttatccctttgtcttgatcactttctcatactatatatataaaacatatgtattatatttatataaatgtaagcaccataagggcaggagtttgtctgcctgtttagtgctataccctggtgtctagaacagtgcctggcatggatattgtgtttgctttaagttcctttctacgcactacattagatggttgagttggttgccctgatctagagtcgtcccctggaatccagtggtgcagtttgtctgtcagtagccctctattccttccaggatgacttctggccgagcaaattcatagagaatgcatgcccctcacctctagtgacctcagtgtggcccaaagcaatagctcctgtactttagctacttcacacattggacagagtgaattatcattgtgtcttgctatcacccctaagaccccctctcttgatttttaatttatccttctacactgatccttttggcaggcttttctgtactttgggttcccaacaaccacttaaatattaatgaaaatcagttgtattagaccgctcttgtattgctataaagaaacacccaagacagggttgttgtttataaaggagagaagtttaattggctcatggctttacaggctttacaggaagcatggtgctggcatctgcttggcttctaggaaggcctcaggaagattccaatcatggcagaggcaaagagggagcaggcatgtcacagggcaaaagcatgagcaagagagaaagagagtgggctgggaggcgccacacacttttaaatgaccagatctggtatgaactcagagcgagagctcacttaccaccaagacgatggcccaaaccattcatgaggaatctgccccaatgatccaaaccccacccaccaccaggtgccaccatcaatattggggattacatttcaacatgagtttgggcagagacaaatattcaaactatattattagtatagaacagttagtaagaacttgggcactgaattcaagcaaacctgggttcaaatccttgtgtcagcacttgcgtctgtgccctttacaagttacttaaaactccctaccattcagttccctgatctgtaaaaattagttaataatatccacttcacatggtggcatagagtaagcattcaataaacacttcctgttactatcactaataatttgtgtctagacttgtccctccaggcttaatcatttgctgactctctagacctgtgacagcacaggcaacactggatttggagttaagaatcatccaataaaactcagccacatcatctccctgcccacatctcccactatgcctgttaacctagaggagtcctgcctgtagattgcatgggacagcaacatttcaaaagatgcttttgataggaaaaaagagtctacatcacaggaatgctatttattttttatttaacaaatgacatttagaaataccaatctgtgctatcactatgatttcaataaaaaatatttcaatgcccctggaaactagaaaaaatacagaacaaacagccctcctaaaaatgaagatctagcaacaatatctgaaccatgccatctatgtttttctcatttcactgaagacctatgaaaatgtagtacagataaacactggcccacaggctggcatttgaaaactcctctttgccatacccaacctatctcaaactctctttaagagcctccaggttgggaggccaaggcgggcggatcacttgaggtcaagagttcgagaccagcctgaccaacgtggagaaaccccgtctctactaaaaatacaaaataagctgggtgtggtggcgcatgcctgtaatcccagctgctcgggaggctgaggcagaagaattgcttgaaccggggaggcagaggttgccgtgagccgagatcatgccattcattgcactctcagcctgggcaacaagaccaaaaactccatctcaaaaaaaaaaaaaaagtctccaggaaaaattctgtagtctcctttaaaccaaactttctaatggtcaatcctactctctgtcagaaacttcaatcttctgtgaaattccgtgactcatatgttgtagcttgtgatttgttttaattaactttagtatatcctcactgccaaacaaataatagatgcataactgcatatcagatactttgcttgtatagcctgcatagagttaggacacatgggctttcctggatattcctaatacaatttatccatacatcagatttttttctctctcacacagagttatgaaactttgctcccaccagctagcttcatccaaaatgccctcaccctagaatatcctgaagaggtaagacattactagataaaaagttgaataatgcaagaagtaataattattcaaataacaatataaagaatgtcacaagatagcatatcattaattgccaaatgaatggcattaaaaatccatgctttggtaactcagaattagtggacacctttaatgtctgtattaacttgttcataagatagcacattactgctttcatatatttctcccctatctctatttctatattccaactttctaactattgtctaactcctgatcttaggaggagtctttctaacctccatgtcaaacatttttcctttttttcctgtcttgagtcctcccaactcctctgatcaaacctctccacttcttaagtgcacccaacacaattattgccattaagtacctcctgttgtttgccatattctctgtatcctctacaacttctcatggactcccaattactggcttacctgacagcccctttctaccttgttctgtgctactgtaagatgctgcttctgtcttcttccttgactaaactgttcttgggtagtcaagctccatctcctagctccccatgctttctccacctccaccacatttattctcttatttcacacatctagccatactaacttttagttaccatccctgtgatttttatagaattaaactgcagtttttagcactggcctagcagtcagaagacctatgcttaagtcctgaagagtcttatattggctaatgttgaacgaattactgaatcggttatgaccacagaattaaaatggtggtactagacattggtactattaaaaattgtattacttcatgaaataaaaatttgacaaccctctaaggtagcctttgcccctaacagtaacattaaaaactatttttggaagtgttgctaggacatgcacactacatgtctaacaatccctacgttagtgggcatggtgagagataggggtagagaaatgatgcggctcagtttttgccaactttaggtccagtagggcttgaggcttgtgagagatgagtttggaagtcagcaagtgctaaatcctggagagacgtgtcttgacacaaactactgattataataataggtaagttattgagtgtaaccaaattaatacatcaacaaatgatgtgtgtgactgcactttgtaagtaagtcaggacaaccactattctgcagctgattaaatcctactgacgttacacttgggtacccggtgcttttggacaagcaatgtaagagaagtgatggtatctggggctaggtcatggcctgtccctgccccatggagggcttctgctctctgagactttgtatttttaccttaagacagagagcctttttctctagtttcaaaaattgtatgatatcaatgacaattttcagttttttagtccattatcttcagtaacaacctgttaactattcacatctattcctctgttgaaatttctagtccagcatcacttttatttattttaataatttatttaaaaccataaaatcctttttcaataaaataataacataaatgtactgttgaggaattttatttcaataatgccaatttagcaatattgttatattggtactacttcattgtggtatgtattctttgtcagctgtataagtgagtattctttctcaagaatagagatagtttttcagagagatatgcaatcaacattatcaggttgatcatctacagcaaaaggatctcaatttggggggggaataaaataaatttatttgatattacttatatgcaaagatatattgtttctttggaaagaaaggaatgccatatagcttttaaattcatagataactgcccccaagtgatacttgtcatgaatataaataaaattgaagaagtcagtttggtacattaataaccacccaagggcagccaaatgtaaggggaacaattcagcctcatatccaaatgttttgtctgaacaatgacagacacatggacattttaaatattcaacatatgtagaatgttgaggttatctagttaaaataagaggattgattgccctcaagaaaaataaaaagaaatcaatcaactggtcctagacataagcaattaacaatttaaaaggaaacaatcattcttttcaaccatattcacatttctgagaactgtttctgagtgagcaatgatagaaaaggaatttgacttaggccagggagcatgagttctggtcccatattttccaagtaccaaccgtgtgacctcaggtaaaattctttcttgtttaggcatcattttctacacatgcacatttataaatgaatgtaatcttgttaaaacctaaattgaatatgtcactactctgctggaaaccctccaatggcttccaaatggagtaaagaccagtcttgcagtagctgttgaggctgtagatctggcttcccatttctcctcctcctctcatctccccgattctcacttgctcactctatctcagccatgctggcctccaacagaccatgcacactccctccttttctcccctaggtattcatgggtgtggttcatttctatacttgcttaattccttacttaaatgtcatatttgcaatggggcagccctatcccaacatttcttatgccctttccagctcaatttttctccatggcgctaataaccatcaaacatactatacattttacaggctgtgatggttaattttaatgtgtcaacttgactgagctaagggatgcccagatagctggtcaaacattgtttgtggttgagtctgtgagagtgtttccagaagaaagcatttgaatctttctgagtgagtagactgagtgaaaaagatccaacctcttcaatgcaggtgagaatcattcagtcattggggcccagagagaacaaaaaagtggagaaatggatgaatcctctctctcttcttgagctgagacatttgtcttctcctgctatctgacatgagagttcctggttcttggtcccctggactccagaattacatcagtgccctatcttgtcctcccacctccccagttttcaggccttcagaatcagactgggggttataccattggctcccttagttctcaggccttcagactgaattacacaaccagttttcttagttttccagcttgcagatggcatatggaaggatatctagacctccataatcacatgaaccaattctcataatcttcttttaggttctgtttctgtggagaacccagaataatatactggcttatcttgtttattgtctgtctttcctgattgattagaatgagagctccacaagggcagggatttttatctattttattcactattgttttctcagcacctagaaccacacttggaacataaaagacactcaacaaatatttgttgaatgagtagatgaattaatatatgtcctgaacatgtgtagcttgccatacatcatgatggttgctgaaaatccagaggtgaataaattggaatcctaaccctaggggaggtcacagactgttggtgtaagccagcccttacctaaacaaccgggcaagtttaataagatagatgttccaacctccacattgtagttacctaactaactcttctacagaagggactgaggaagatttcacggaagaaagaatgtttgagctgagttatatagcaatttatcaattggatgagactagagagaggtctgtataaagggagggaggggtcatgtataagggcattccctacatcacagtgttttaaaagttaaaaagaaatagtgtatatggaagtgctttgcaaattaatgcaacaatagagtgcagttcatcacttggtatctgttggggattggttcctggacctaccaaggataccaaaattcacggatgctgaggactctgatataaaatgggtagtacttgcacatagcctatgcacatcctcccatctagtttaaatcatctgcagattatttataatacctagtacaatgtaaatgctatgtagatattatactgtttcatttaggaaataatgacaagaaaaaagtctgtacatgttccatacagatgcaatttttaaaaatgtatttttgacttgtgatttgttgaattaatgggtgcagaacccacagacacagaaggccaactgtatatgtactattatttacctgtgttaatttttttcttttcccaatggcatcatctcacaagatattccatgatgcaactttgtgacaaaagacaataatatgcatttgaattttattgaaatagcttctcagaattgaaatattcatattggtcaaagaatatatgtcaatgaacatatgaaatagcatgcctcagcatttttaaatctgtttttcagtaattaaaagctgttatctctaatttctcaggctgagaacaaattaagtaggacactgaaaaaaattagtcttaaaataagccatgctatatttctcaagtgtacaaattgttaattagaattgggaagtgaacagaaggagcttaaaataaagaccttcaatttcaaattaaagctgaaaatggacccatgtttggcactggcgttaataaagagctaagatttatggaggctgaagtagaaatagataattttaaaaatgtttaaataattttgatttaatgtttttatacttgattgaaatgtgcattttttaggattttaaatattttagaatattttttaagtgagaaattatttttatattttcacatttactttacattttataatgtatttaaactttgtacactttgaaatcaattgcattttgatttcagtaatttagattagggttcagcaaattatgctttgcagaccacatctgcctgtcatgtgtttttatatagcctacaaaagctaagaatgggtttgagggtttttctctttaaaacatttttaaatagtattgggaaaaatcaaaagagtaataatattttttgcatgtaaaatttacatgaaattctgattttaatgtctataaataaaactttcttcaaacacaaccacaaccatttgtgcaattacatgttgtttacagctgctttcattacaacagcaaaggtgagtagtggcaacagaaaccttatagtccaaaatgctgagaatatttaccacatatcttttatagaaaaagtttgctgactcctgctttagatcattactgtcaatagagcacaaaaataacttcttttataagcaaatcatttatccatttaaatttaaatttgtttttaatttttctgaaaaaagggtattttatttgccctaaaacagaaaaacacaaggccacagaaacataccttattttgaaatagaagaaaaaatttaaaatatgcaaatatttgaatttgcatatgaatgtagctctcttaatatcctctacatacttttattataaattgacaaattgtaattaatatatattacagttatatacatatatgaatgtatacatattattcatattatacagttaataccaattatactatatacatattatagtatgtatttacgggataaaaagtgatgttataatttatgaatataatgtggaataattaaatcaagctaatagacatatccatcaccttaaatatttatcaattttgaggtgagaacacttgaaatttaccctcttagggattttgacatgtataatacattattatttattgtattcatcaagctctgagtctatctccaagaaaatagagactttgtatccttttgaccatcatctccctatttccctcaaattcccagcctctggtaatccccattctactctctgcttctttgggtttgttttaagtttctacatgtaaatgagaagttcattcagtatttgtctttctgtggcttatttcacttagcagaatgttctccaattccatccatgttgtcacaaattacaaaattcctttcttttctaaggctggatagtacattgtgtatatatatatgtatatacacacacacaccacattttaaaaaattattcatttgttgatggacatttaggttgacttcataacttggctactatgaacactgttgcaatgaacaggagcatacagacatttcttccacatactacatatctttttgggtaatactcacaagtaagattactggatcatatgataattctatttttaattttttgagaaatctccacacagttttccataatggctgtactaatttacattcccattgaaatatttttaaattttgttactcttctaaatatcacggatccatgaatacaatatataaaatcatagctttacacatttttaaaaatttttatattctgactgcatgtttgataatggaggaggaatgaacatgttaaaacatgttcaatagtttgttgacttgatttccagctttaagtatttagacatagggtagatggggctctatttgtactttgctctggactcagcagtgttagtggagctgagaaaaggagcaaacagggataagcaggaagggtagaggaggtgagcagggtgatggcaaagtactgatttaacagaaaacacttacttaaaaaaagaaattgagcaaattagagtcaaagaggcatgcacatctctgtgccctgtgggaatctgtgggtactaataagtagattagttataggaaaagcttttgtttttcttcggtcactccacatatcacgaagaagcaggcagaagcacagtaaggttattagtcatactgttacttaatgatgagacatgacaaaatcaattcatgcaccaaaaattattaagaatttagaagttacagaaatatgtaatttcacagttatctatcataatgacctcccaaggaactttcaaccttatgactctattacttaatagatgtattaatagatatattacttaatattgcttgtgcctgagactcatttgtacaatcaactaagtatctatttggttccagatacttcactagatctgtggactaaagtaatagaaataagcagtccagtctggtggccattagccacatgtggctatagagcacttcagttgtagctggtcaaaactgccatgtgttctaagtataaaatgtacactgaatttcaaagacttactatgaaaaagaagaatgtagacttttttgttataaactataagtttttatatgtattacattttgaaaaaactaatattttagatgtattgggtcatattaaatgtcattaaaattaatttttcctgttcctttttaccttttataatgtggctagtaaaaaatgccaaattacacccatggctaccattgtatttccactggacaatgttggaataaaagagagtgtcctcagggaactcacattttagtcagatcaataagtaaacaagcaatgacaggtgaccatcaagtaaacatgagctgctttgacagtatccaaagaagatgctcagatgagcccaggaggggctccagagggaatctggagtgagaggtgatgcctgggctgaattttcacagatgggcaggaggcaaccttcagtcaggtggagaacattccagctagagaatacagcatgtgcaatgtcacagcagtttgaagtagcttctcatatttggaaaactattaatagtttgatataatggctgggcgtgctcacgcctgtaatcacagcactttgggaggccgaggcaggtggatcacgaggtcaggagatggagaccatcctggccaacatggtgaaaccctgtctctactaaaaatacaaaaaaattagccaggcgtggtggcaggtgcctgtagtcccagctactcaggaggctgaggcaggagaatcgcttgaacccgggaggcggaggttgcagtgagccgagatcatgccattgcactccagcctgggcaaaactccgtctcaaaataaataaataaataaataaataaataaactgtttgatacatttaaaactaggatgggtttttggagttgggaaaagtaaagctagacaggcaggaatcatcaatgaaaggatttggaagtcaggcactaaggaaaacttggaggaaatttagatctggtctttatctaaaaatgtgcccttttccaataatgttgaagaagcacttacaagctttggaatgaaccttctccaaaacagcctaatgtgaattctagaaatgatattgattgttcctttgcaattgttccatgaatcaactaacttaaaactattcaaacagaggaggagtgcccaatgttgtgtggtatatgaaatataaataatgcttagaaaggtgatgaaaagccaaaaagccctgttaggtaacaggggaaaaaaggttttcaggaggatgcaaccattagaaaaaggctacttacttcagcttgtaattcactaattatttatgcaaaaaggaagcagtattctaccatccagcatacagcttttcatgctttatgcagtcttcacgagaaagagacaaatgaccataacctcaaggactttgtaaataaatcatgtttctgggccagttctgcactggaagttggtcaacctggcacaaccattgtttagcttttgcctgcagagtactattctgccaacagctgtggccacctgcctccccccaaaaacttcaactttacccttcatcctggagccaattgattcctaagtaaggaccactttaaggacccctaatttagcatgttatttggcttgatatcacttcatatgtgttcttaacctcaaatcccaggtctgataactaggctttggaaaagcactttactttgaacctcagtatcacctgaatgggcacctgtcattctctttcatcacatctgccaagtgctgtgtttcatattcttggccaggccttctcccttctttttacctctcaggcctgtcctactccagtaagcacactgtgattctggtacttgcccacctcctggccagtgcaccgcagcttatgggcctggacacccctacttctccatcagtagccccagttttgggctccatattgaaaatactcactgagaaaagcacgctttataagaactcaggagaacttgtggcttctgttgcaaaggctatttttaaccctcgctattatagtttttaaatgtgctatctgattaattttgtaagcttggattctctcttcacaggctaattgactcattgtaataccgaagttgaatcttcaaaagtgtctgaatgcttcaattttcactttattctttctcagttctttggtttttttgaactaaaaagtagtcttgattgccaggggttggaggtagattaaccgttcagctagattgtggaaaaatggaatgagtagttctaaaagccaagcaccacctcctttgatacaaatagcctattctccttacatgtctattaacttgcttagtttccaatcaagactgggtagacaactttagctggtcaccaaggagcccagtgtctgatcctgggtctcatttaccaaagagcaacagccggaatcactgtcttccaagtgctttcttcatggatgtactttgggttctataggtttactccagtggaggactggatctacttttcttttgcaaatgatttgttgtaatctacagacctatgtcccgcacgtggaaaataaaattaaataggaagaagaggccatggagaatctattgcattgttcagacttcggctgaagatggctgaaggtttcagtcgtctacttttggttagtcatttgagatgctgagtgactccaggaagtgatggtttatgggtaatgaaagacaaatacttctcctggggattgtgaatcctttacattcgagtaattttaattttttcatctggaactaaataatgcaaaattaatttcatatttttatctcttcatcatcctgtggtatttaaacacttttttaaaagtgtcttatttataagcctgcttcttaggagaaatctttactgatttagaatttataaaccaaaagaaggggtgcacaaccacaaaaagagtataagagaggaacaatagaagtgaccatgaccatccagactcaggaagatggacatgtacatcttctgttcctaatcatcaggcactgtctttggtaaatttgctgcaaggccctgttatgtgggagcagtgtggagccagaaaataggataggcttttggaatgattcacagcatatgaaggcagaattgatgactctccctggaaaacaggatatattcgtaacaataatgaaaactcttcaaatgcaaaagtattttcttaggtgacttcaggctgaaaaaaggctatcttcagtagccacatacatctgtattcttattacctaatttgtagcacgtggtggagcagcccaggcagtattgaaggttaatctcagcattagtgtggcatcagtaattcattctgtagagctggatcttccactcaggtttaatgcatcagacaatcagttccagtcacaataaggtggcatgtagaggtatctggacaaaaagaataatttctttatgagggtgtgttgttgatttttaaaggtcttttctaagaggtataatatcaaacagatcactgactcttgggtggttgtttttgttgatgttgttgttgttttaactttcagaatatttgggatctgttaaatctcatctctgaccaatcgcacagacaaaagctctttaaggaggaagaggtagtaaatctgcatctgttatgtgattgcttaattggtgtcaagctacaggctcctgactcccttgtttttatgtcacactcacacttcactctttgaactcccggtatagcactctcaggaagcctcttagctctctcaggcagaaaagcaagtaactgaaagcaactctggaagttggatatgttcaccatcacctgttattatcacgcagacacagcctcttgtaaaggctttgtatctgagaagtctgcctctaaagtcactgtggcaattaataatgcccaaacctaaatcaaaattcctattgctgctcttgctggtaatataagattcttcctgtttctttcataaattagttgataactgtctctgcttctctgttgagtgaaaggattttaattacacaatgcacaggagcacaaagcttcatctcccggccagtggacaatggaggcttgtgataaaagcacattaaaccttcattgaggttgtttacacatttgtaacagtggctgtgtttgtctctgatagcagggacaataaatcaaaaccttaggatgttcttttcattagccaatgattttatagcctgtggtggctttttaaccatccatgcataaatggagtgatataatatgtaattactggaaataactagaataactaggtgggtttttttggtttttgttttttttttttgagataaagtctcactgcaacacccaggctggagtgcagtggcacgatcttggctcactacaacctccaccttccaggttcaagcgattctcctgcctcagcctcccgagcagctgggattacaggcacccgccacgatgcctggctaattttttgtacctttagtagagacagggtttcaccatgttggccaggctggtctcaaactcctgacctcaggtgatctgcccaccttggcctcccaaagtgctgggataacaggcgtgagccaccttgcccagccaataactagttttaattcccccaacagatatttagggctttcatatgattctgaagatttatgtagtgcattgatgagtgtgcaacactaatcacccctattagtgtgcaacacctacaagttccatagactttttcctcaggcctttaatggggattacattattcttctaactcagagttatggacaccatagtggcaatgttgatctcaaccacatgacaaaaagaaaagctgcctggcttcctggggaaacagttgggtgggaaaaagaaggtcagtgccttcaactctgagaagaaatatggagagaggactctctgggaaaatgagagaggtccgtgttctcgcctagctctaccatgtactatgcatgaaagaaatcaagaatgctgtggcccatttgaagtactcaactatattttctctttgttttctagcagggagtcacaaatacaattttgcattgcagagccctagttcgatgcctaagatgtggatttaattttaactaagatccaaatgtaacaatgttagagaaaatacagcagaaaggaaaaaatttaaaaactatatctagtttgtaatgctgagtaaagttgccttgagtgtccaaaagttcctggaaatatttgtgaagttctttcattgaaaaaacttgacttttaaagataggcagtcctacactcccaagaaggtgattgacagcacaaatcccattcatcgatgggcattgggttgtacagtctttctccctcttctagctcttgcagtatcaccaccacatcaggaaacagctgtcggttgctttgttttccatcagttgttgatgtgttgaaggctgacatagtttcaatttatgtgttttctttccataagagtcactagtgatatgtaggccacccaaattctagacatgacatggtcagatagaacttatttcttttcgtaaaaaataagattaattctgcttttaatcttccttatgtcattgttatactagtaccattattatattaacataaaacattaatggtaatattaaaatatagctttatacaataatatatgatggtcattaatactagtatattgcatttataataatatctctatttgcttagcacctgccaagtgccaggctttatatacattgtttaaaatcttcacagcatccaaacaagatggaaattattgtcccagggttacagatgaagaaaaagaatgaggcccaaagagatttagcaactttttcagtgccacatagctagtaattagcacagctaagattcaaataccgtatggtctgactccaaaactcaagtagtttttatcatatcatactgcatctctttctcaagcagtggaccacgctctagtaaaagacgtgttgtatatggaaaaacacagtctgcagcagctcataacagagcttaaagagtggttgctattttagtctctgttaatgctataaatgtgcaaataagtgtcaccttcatgtgggcaaattttaactacctcatgaactgcatttacaaggagatgcttaatttactacagtttgtttatgagtgctcttgtgtgaggtgaatcatttagggcagtttatttttagagttacacaaggagtggattaaaaaaatacccgctcaaacaagaatgtcaagcaaatttagcttgaaacacgaggtagacatagtgtactaagagggctgagaataaacttttgaacttaaagagtcctgattcctgtttgtaaccctgatgcacagatcactggcttgtatttcacaatatcaacttttcagtaaatggaagctttctcttttaaaaactctgaattaaatcttatttacaatagatttgcattgttcaaaaaaaaagtttttagtatatttagtttaggccaaaaaacctggagtcatcctcgacaccttttgtcttatatcacatatctaatcaatccatccaaaaacccttgatggtggcccttaaagatttatggagaatatgaacacttcttcccagctctacagttacaccctggtctcagccatcatcatttctcacctggatttctttttcttcttcttttttttttgtacactccattaccaaggctggagtgcagtggcatgatcttggctcactgcaacctccacctcctgggttcgagagattcttgtgccccagcctcccaagcagctgggactataggcatgcaccaccatgcctggctaattttttatatttttagtagagacgggtttcaccatgttggccaggctggtctcgaactcttggtctctcaagtgatctgcccacctcagcttcccaaagtgctaagattacaggcgtgagccactgtgtccagccatttgcctggatttctgtaatatcctttgaacaggtctccttgcttcacagctttcttggtcactatagcgtgggaaaaagagagctggagagttgagctgtagccataaatgcttcggcctaatagtgacacatatcacttctactcattcttttttccatttgactagaataagtcacatagccacacttactttttttttttttagttcattttattattactatactttaagttttagggtacatgtgcacaatgtgcaggttaattacacatgtatacatgtgccatgctggtgtgctgcacccattaactcctcatttagcattaggtattctcctaatgctatccctcccccctcaccccaccccacaacagtccccagagtgtgatgttccccttcatgtgtccatgtgttctcattgttcatttcccacctatgagtgagaatatgcggtgtttgattttttgttcttgcgatagtttactgagaatgatgatttccaatttcatccatgtccttacaaaggacatgaactcatcattttttatggctgcatagtattccatggtgtatatgtgccacattttcttaatccagtctatcattgttggatatttgggttggtcccaagttttgctattgtgaatagagccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgctgtttcttgaccttttaatgattgccattctaactggtgtgagatggtatctcattgtggttttgatttgcatttctatgatggccagtgatggtgagcatttttgcatgtcttttttggctgcattaatgtcttcttttgagaaatgtctgttcatgtcctttgcccactttttgatggggttgtttgtttttttcttgtaaatttgtttgagttcattgtagattctggatattagccctttgtcagatgagtaggttgagaaaattttctcccattttgtaggttgcctgttcactctgacggtagcttcttttgctgtgcaaaagctctttagtttaattaggtcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataagatgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctattctgttccattgatctatatctctcttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcataggtagcttgatggggatggcattgaatctataaattaccttgggcagtatggccattttcatgatattgattcttcctacccatgagcatggaatgttcttccatttgtttgtatcctcttttatttcattgagcagtagtttgtagttctccttgaagaggtccttcacatcccttgtaagttggattcctaggtattttattctctttgaagcaattgtgaatgggagttcactcatgatttggctctctgtttgtctgtgattggtgtataagaatgcttgtgatttttgcacattgattttctatcctgatactttgctgaagttgcttatcagcttaaggagattttgggctgagacaatggggttttctagatatacaatcatgtcatctgcaaagagggacaatttgacttcctcttttcctaattgaataccctttatttccttctcctgcctaattgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaacttattgagagtttttagcatgaagcgttgttgaattttgtcaaaggccttttctgcatctattgagataattatgtggtttttgtctttggttctgtttatatgctggattatgtttattgatttgtgtatattgaaccagccttgcatcccagggatgaagcccacttgatcatggtggataagctttttgatgcactgctggattcggtttgccagtattttattgaggatttttgcatcaatgttcatcaaggatattggtctaaaattctcttttttggttgtgtctctgcctggctgtggtatcaggatgatgctgccctcataaaatgagttagggaggattccctctttttctattgattggaatagtttcagaaggaatagtaccagttcctccttgtacctctggtagaattcggctgtgaatccatctggttctggactctttttggttggtaagctattgattattgccacaatttcagagcctgttattggtctgttcagagattcaacttcttcctggtttagtcttgggagggtgtatttgtcaaggaatttatccatttcttctagattttctagtttatttgcatagaggtgtttgtaatattctctgatggtagtttttgtatttctgtgggatcggtggtgatatcccctttatcattttttattgcatctatttgattcttctctcttttcttctttattagtcttgctagcggtctatcaattttgttgatcctttcaaaaaaccagctcaggagccgggaattgtaatctttttaatcagaaatagagaactagatacaagtgaacataagtattgataccacaacttagatctaagccacttggtgatgaagggaaaaagtgaaagtttaaattgctctctctgcctaataagatcacaccagttcataagagagaaaagcttttacccacatcttgcataataaacaacagttgaacaaccgcacatgatggcttatgcctgtaatcccagcactttgggaggctgagttgggcagatcagttgaggccaggagttcgagaccagcctggccaacatggcaaaatccagtctctactaaaaatagaaaaattagcaggtatggtggcgtatgcctatagttctagctactcaggaggctgaggtatgagaattgcttgaacctgggaggtagagggtgcagcaagccgagatcacactactgtacttcagcctgggagatagatcaagagcaagactctgcaaacaaacaaacaaacaaaaaaaaaaaaaccaaaaaaaaaaaaaacccagaaataatcagcactatctaatccaggcaacaaacacttgccaaaaatgaaacacttgttcaaaaatgaacactttcttattgtagggtattttagagcatttttaaaattatactttaagttctgggatacatgtgcagaacgtgcaggtttgttacataggtatacatgtgccatggtggtttgctgcacccatcaactacattaggtatttctcctaatgctatccctcccctagccccccatcccctgacaggccccggtgtgtgatgttcccctccctgtgtccacgtgtcctcattattcaactcccacttatgagtgagaacatgcagtgtttggttttctattcttgggtaagtttgctgagaatgatggtttccagttttatccatgtccctgcaaagtacatgaactcatccttttttatggctgcatagtattctatggtgtatatgtgccacattttctttatctagtctatcattgatgggcatctgggttggttccaagtcttggctattgtgagcagtgccactacaaacatacgtgtgcatgtgtctttatagtagcatgatttataatcccttgggtatataccaagtaatgggatggctgggtcaaatggtatttctggttctagatccttgagaaatcatcacactgtcacaattgctacaaagagaataaaatacctaggaatacaatttacaagagatgtgaaggacctcttcaaggggaactacaaaccactgctcaaggaaataagagaggacacaaacaaatggaaaaacattccacgctcgtggatacacgctcatggataggaagaatcaatatcgtgaaaatgaacatactgcccaaagtaacttacagattcaatgctatcccaatcaaactaccattgactttcttcacagtattgaaaaaaatactttaaatttcatatggaaccaaaaaagagcccacatagccaagacaatcctaataaaaagaacaaagctggagacatcatgctacctgatttcaaactatactacaaggctacagtaaccaacacagcatggtactggtaccaaaacagatatatagagcattttttaaaatgggcttagttagttcactttacttttcttgtataaaaacactatgtcatggccatagctagaacttgggtcctgtgtgtggaaacttgtgtggtctttacaagatggtcagtgaattcttcatggagagacttggcaacagtctctttccagaggtcaggcatcagatagctgtaggtcttggagatggcatcaaaggtagccttggtaaagttgcctagggtggcagtgcagccctgatcaaggtgtagcagtcattgacactggccatcatcagtagcttcttaggcaaaggggcagagacattgccagtgcatctgagggcagagatgaggcacaccagcacagggccaaagtggtcagtcactccacaaggaatgatgtggagcataccaatcttattccccaatagcttctgcatggggaaaatggagagcttggccagggtgatggaccctcagatggcagtggctacctccctgaaacatttaacacccagatgatgtggccactgtacctggtccactggccagcaagagtctgcttttgcatgggcataatctttaaattttcatccttgagggatgcccccaggaaaaagtcaattatctcagcatttttatgggcagggagaagagatagatctcttccagggacttgatcttcatgtccttgaccaggaagcccagcttggtgactgggagccactcacctctgtcttgcttctgtgagctctgcaggctcccagaccctcccgcagtcctggtgttatttgccctttggtgttctatcagacaggcagctctttagagtatttttgaccaatgaattcagatacttcttaagggcactattgaattatccaatacatcaagaattggcacacattttctttaaaagtccgtatagtaaaatattttaggctttccaggctgcatggtcttgctagtgactatacaactctgccattgcagtgcataatggtcaaacaccatacataaataattgagcatgtgttcttacacacacaccacacaaacagatacacacattatacacaaaaatggtggtgagcttaaactgggccatgggctgagctgtagtttgctgatccctgtaatacaccatccacataccagtgcttactctaagtaatatcaagtgatatcagtatagactttaaagggagtggacagaaaattcagttatctcaatagttgccatttttgccatataaatttatttctgaaaaaaatagaagagctattagaaacataagaaattattcagttaatgacaaaatattaaggtaatttccgctaggcttgaagtaaagaacatgaaaagaatgcctggtacacattcattattcagtgatgatgattaggcagtggaataaaaaagcaaaaaatgtggaataaatattggaaagaaggagagcaaattataatttttttataaggagtatgaaactctacctggaatatctaagactatcaactgcaaaacttgtaaaattagaaaatcaacaataaggtaaacattaagaaacaattgctttgctatataccaccaattgcacttagaaaatgtaatagtaaagattttactaacaataagccagaaatttaaaatgccaaggagtaaattaagaaacatgtaaaacctaaatgaagggaccacaaaatttttctgaaggacataaaatactaccaagaataatgaagtggttgttgagtttctagataaaagatttagtaattttaaaatgtcaattttccttatatatatttatgaatttaatgtaagccactcaaaattcctacaaatcttttgtggaagtggacaagtgattttaaaattctgtgggaagataaaatgtgaagacagaattaagcaaaatgtgaaaaagaggaacattgagggacacttgcctttccaaatatcagaatttctgtaaggtcactgtaatttaaagtgttctgtagttttgaaaaataaacaatagatcaatgatacagaatatggacttcacaggttaactcatataaaaagaaatttgtaataaagataatatttcaactcgggaaatggataaactatttcataaagtatcttgaaacaatcattttattcatttgaaaacaagcataaatcttcatcctttcctcatgccatatataaaataaattccagatggcctaacaatctaaatatacgaatttattaaagcattagaaaatattttacaagctcaggctaggaaatgtctttcgtaagacaccatacaatcctggacccaagaaggaaaatactgagatattttatctaaatagggtatatgggtgtgtgggtgtgggtgggcgtgtgtgtgtggacacaatatataatatgcagcaattcatattttggcaaaggcttaatatctccaatatagaaaaggctcctaaaattcattgaaattagaaagtatattttttccaaaaaaatgaacaaagtctacatatatttaatattttcttacatggcagggggtatttttaaagcatcttatttatttaatcctcacaaaaattttattttatatattttttccaaacattactaatcattttagaaaagcatgttaaaaatgttcctctatctgatggatgaaagttttaaagactcagaatatgaagtgttagcaaggtttggggataagattaccctcatctacatagggggaataagcacagaatttttggaggacaatttggctgcttggtcactctttaaaatgatcatgacttttgacttagcaattccacttatagaaaattctcctgcataaatacttgcatatatgtattaaaatacatgcataaggataattagagaagtattgtttctgatagaaaaaaatggaacaataatgttgcagtgcattactgttacaaaccaagaataagacagagaaatgtgattactcttttaccttaaattgtttgaaaaaatttgcccaagagttggaaacaggcaaaagaggtttctggatattcttccaatggagtagagttgtccatggtgactctacatgaatgatctgattccataaggtgggtgcaactttttcattctattaagtaagctattttataactgaaatggtagaagttttagaaacagatattaatgcaaatgattcctgttcataggaatgcaaatgaattactccatataaatacaatcgacttgggccttatggaaaaagataatctcaaacataaaatttaattgctccatggaatattaagcagttttacatttattaacaaattatatttcacaatcctgattgcatatatatatataaaatgtttgttcttcaatttggcctttgaacttgttatttaaccattatttaacatattattgactccctgattaatttatgaatttagaacaaactttgatgtgattgttttatatttgcatgagagtcaggataggacttttgtgaaagttatagatcagtacaatactaaagtggttaacttttatgagacaagaagttctttattgcatggtcttggctatggctgtaaccattttttcttatttaaaatcaaaatggattttattatgccctggacaagaattagattctatttagtgatactgttgaactctaggttgggataattatgaggcttatctgttatacatgaaaacaagaaacgttttctggacgttctgtgtcatcttatctcaaggtccttcaacacagatctaagataaaatttatgctaaaagagaaggggattatggacacgaaaaaaattgaggcattctagtgaacttatttaaaaaaacaaaaccaaacaaacctcagcttctgtgaaagttaacatattaagaatagcccttaaaatattttttaatttttaaaattcttaaattttttcccctttaccaaggtaaaatgcatcatcatattaaatttcaacaaaacagactcttgccctgttctatccatttggccacatgtgggttatcaacattggtatttgttgaggcagaagtgaaggcacaattgtgtagactttgtcatgcagccaattcattcattcttcttgccacataagcaatgcctcagggagagaaaaaaattaaggtgcttaaggaaaggaaacaaaaaaacagaactcaatctgtacagctcagtgaagtaccacttgctttatcctttcatacaatcagttaatcaccctataaaatgctgaaatcatcagagcctgagctgaaacagtgagttcaatttttttctctcctttaaatgtctccttttcagttatacagtattttatgaaaaactgatgtcttggtagtcaacatgatgaatgtggggacacgcagggaatagtttaaggagtttgttttaacagttatgcatttaaattgtcccattatagtggacatgtttctactgccaacaaaaaatcagttcttaaagatccagttctcctagagtttttttactgctttcaatcattttgatagcaatcctgatgaattcatgaattaaaattatttcatccaaatgttagatttcaaggtggcagttcagggtcttcttttcttgtattgcagggacttaacatataatactaaagacattttgagttaaaaatatgatatattctctaaggaaaacctttagatatctaggtacagtggggctaaaaatatgatatattctctaaggaaaacctttagatatctaggcgcagtggggcatttgcctgaaagcaattaagttttacaatgtatatctgtataaaaaccattcctgctactcaatgtacttttgtttcagtctagttcttaagtcaaggtcctagcctcagaacctgttcctaatagctgcacaagaatttattgaatcaatgagcacatagaaaacattatgcattattctgttccatcagtgggagaacaaagataaattctttttatttctctttgcccttctttgcctacttacccccaaatcatgaatttacacaataacatagctggatcttaacaaccattaaagtcaatttctatactttacagatggagcatctgaggcttggagttttgaaggggcttacccatgtctacacagcaagttaatggcataacagccagatgcaaatccatgccttccagctgtaaatccaatgacactcattatgtcagactgtgtttttgggtttggtgtgtttccataacatcagtaaaggttagagcgagactctggcaacctgtccaggtcttttggctttttttccttctggagggaaaagagaaaggtcctaaaagactttttggtgtttgtttgttttttctttcactgcccacatctttggaagcacctcagagttggcaaacatccccttagttgcctgtcatcagctttagttatttcattcacacaagcagagtcatttctgagctttccacaaagcagtgctactgtcaacacaatcaggccagagtcaaagtactattctatgattacatgtaaacatggctgagatttaagaaaatgttcttgccagcactctttttttccttttattattatactttaagttttagggtacatgtgcacattgtgcaggttagttacatatgtatacaagtgccatgctggtgcgctgcacccactaactcgtcatctagcattaggtatatctccaaatgctatccctcccccctcaccccaccccacaacaggccccagagtgtgttccccttcctgcgtccatgtgatctcattgttcagttcccacctatgagtgagaacatgcggtgtttgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagagccgcaataaacatacgtgtgcatgtgtctttatagcagcatgatttgtagtcctttgggtatatacccagtaatgggatggctgggtcaaatggtatttctagttctagatgcctgaggaatcgccacactgacttccacaatggatgaactagtttacagtcccaccaacagtgtaaaagtgttcctacctctccacgtcctctccagcacctgttgtttcctgactttttaatgattgccattctaactggtgtgagatggtatctcattgtggttttggtttgcatttctctgatggccagtgatgatgagcattttttcatgtgtcttttggctgcataaatgtcttcttttgagaagtatctgttcatgtcctttgcccactttttgatggggttgtttgtttttttcttgtaaatttgtttgagttcattgtagattctggatattagccctttgtcagatgagtaggctgagaaaattttctcccattttgtaggttgcctgttcactctgatggtagtttcttttgctgtgtagaagctctttagtttaattagatcccatttgtcaattttggcttttcttgccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaagggagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatatctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtttttgccaattccatgaagaaagtcattggtagcttgatggggatggcattgaatctgtaaattaccttgggcagtatggccattttcacgatattgattcttcctacccatgagcatgggatgttcttccatttgtttgtatcctcttttatctcattgagcaatggtttgtagttctccttgaagatgtccttcacatcccttgtaagttggattcctaggtattttattctctttgaagcaattgtgaatgggagttcactcatgatttggctctttgtttgtctgttgttggtgtataagaatgcttgtgatttttgtacattgattttgtatcctgacactttgctgaagttgcttatcagcttaaggagattttgggctgagacaatggggttttctagatatacaatcatgtcgtctgcaaacagggacaatttgatttcctcttttcctaactaaataccctttatttccttctcctgcctaattgctctggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgaaataggtcccatcaatacctaatttattgagagtttttagcatgaagggttgttgaattttgtcaaaggccttttctgcatctattgaaataatcatgtggtttttgtctttggctctgtttatatgctggattacatttattgatttgcgtatattgaaccagccttgcatcccagggatgaagcccacttgatcatggtggataagctttttgatgtgctgctggattggttttgccagtattttattgaggatttttgcatcaatattcatcaaggatagtgatctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccgtctgggcctggactctttttggttggtaagctattgattattttcacaaattcagatcctgttattggtctattcagagattcaacttattccttgtttagtcttggtagagtgtatgtgtcgaggaatttatccatttcttgtagattttctagtttatttgcatagaggtgtttgtttgtagtattctctgatggtagtttgtatttctgtgggatcggtggtgatatcccctttatcattttttattgcatctatttgattcttctctctttttttctttattagtcttgctagcggtctatctattttgttgatcctttcaaaacaccagctcctagattcattaattttttgaagggttttttgtgtctctatttccttcagttctgctctgattttagttatttctagccttctgctagcttttgaatgtgtttcctcttgcttttctagttcttttaattgtgatgttagggtgtcaattttggatctttcctgctttctcttttgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagctggttgttcagtttccatgtagttgagtggttttgagtgagattcttaatcctgcattctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgaggtggagagttctgtagatgtctattaggtccgcttggtacagagctgagttcaattcctgggtatccttgttgactttctgtctcattgatctgtctaatgttgacagtggggtgttaaattctcccattattaacgtgtgggagtccaagtctctttgtaggtcactcaggacttgcttcatgtatctgggtgctcctgtgttgggtgcatatatatttaggatagttagctcttcttgttgaattgatccctttaccattatgtaatggccttctttgtctcttttgatctttgttggtttaaagtctgttttatcagagactaggattccaacccctgcctttttttgttttccatttgcttggtagatcttcctccatccttttattttgagcctatgtgtgtctctgcacttgagatgggtttcctgaatacagcacactgatgggtctcgactctttatccaatttgccagtctgcgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttataaagcttagtttggcaggatatgaaattctgggttgaaaattcttttctttaagaatgttgaatattggccccaactctcctctggcttgtagagtttctgctgagagatccgctgttagtctgatgggcttccctttgagggtaacccgacctttctctctggctgcccttaacattttttccttcatttcaactttggtgaatctgacaattatgtgtcctggagttgctcttctcgaggagtatctttgtggtgttctctgtatttcctgaatctgaacgttggcctgccttgctagactggggaagttctcctgaataatatcctgcagagtgtttttcaacttggttccattctccccatcactttcaggtacagcaatcagacgtagatttggtcttttcacatagtcccatatttcttggaggctttgctcgtttctttttattcttttttctctaaacttcccttctctcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaattttttttcaaagttttcaacttctttgcctttggtttgaatgtcctcctgtagctcagagtaatttgatcgtctgaagccttcttctctcagctcgttaaagtcattctccgtccagctttgttccgttgctggtgaggaactgcattcctttggaggaggagaggcgctctgctttttagagtttccagtctttctgttcttttttttccccatctttgtggttttatctacttttggtctttgatgatggtgatgtacagatgggtttttcgtgtggatgtcctttctgtttgttagttttccttctaaaagataggaccctcagctgcaggtctgttggagtaccctgctgtgtgaggtgtcaatcttcccctgctggggggtgcctcccagttaggctgcttgggggtcaggggtcagggacccacttgaggaggcagtctgcccgttctcagatctccagctgcatgctgggagaaccactgctctcttcaaagctgtcagacagggacatttaagtctacagaggttactgctgtctttttgtttgtctgtgccctgcccccagaggttgagcctacaaaggcaggcaggcaggcctctttgagctgtggtgggctccacccagttcgagcttcctgactgctttgtttacctaagcaagcctgggcaatggcatgcacccctcccccagcctcgctgccaccttgcagtttgatctcagactgctgtgctagcaatcagcgagactccgtgggtgcaggaccctccaagccaggtgcgggatataatctcctggtgtgctgttttttaagcccattggaaaagcgcagtattcaggtgggagtgacccgattttccaggtgccatctgtcacccctttctttgactaggaaagggaactccctgaccctttgcgcttcccgagtgaggcaatgcctcaccctgcttcagctcacacacggtgcgcacacccactgacctacgcccactgtctggcactccctagtgagatgaacccggtacctcagatggaaatgcagaaatcacccgtcttctgcgtcgctcatgctgggagctgtaggccagagctgttcctattcggccatcttggctcctccccctcgccagcactctttttaaggagttctaccattacagcaggttggcaaaggacttgagagccatgatgaaggttctggtaggtcaggggttgtcatggagggattttaatttaggaaatgaaatattcaattgacttttgtaaaagtaactttagaaaagtaactatggcagtagcatgttagcatgaaagtaagactggattccgggggaacaattaggaggcagtagctataatcctggtggttctttgcaggtgatttgatctcagaggtcatagaaatgcagaaaagtgaaaggacttgagaggtattttatggtagaatagtcaggaactgataattgtttgaatctgatagagaggagggtgagagattaggagactcaaaaatgattcccaggtttctggcttggttgattgggtgggtagatgtcccattcataagaatgagaagtctggagaaaggacaggtttggaggggaatatgttaagtttttgttcatgttgagttttagtaccttaggacacccaagtagaaacgtcctgcagacagtcagatatactatacagaacttaaatttgtagaggattattcaaacaagtgtgggcaatttgcccagtctacagcccagcccagagaactgttcccactctaaccttatattctagtgcccaccccaaaccctcactcccctccagctacactggcttcattggtgagtctccaaaacaccaggcacactctggattggaggccttgtcagtggctgtttcgtctgcttggaatgttctcctccccaaatctgcacagccaattttattatctccttcaaggctttgctcattctccttctcaatgtggccttaccaagatcacactgtttaaaattgtaatcacagccccttccccgacatattactgatcttttttagctctacttactctttatttcatagttcttatcatcttgtattgtattgtattagatcatgtgtttattcatgatatttattgcttattatgtctctcccactgcaggaaaggaaggtccatatgggcaaggatctttgtctgttcactgatgtatcccaagtgcccagaacagtgcttgggacacaatgagttctcaataaatatttgttgtctatattaatgtttgcttagcacaaaagttctccattttattgacttactgaagcaccagaatctccatgtgggagcccctatttctatcaatcactctctcccctgcattaccacaatgcaacagattcttagagtagtgattctcaaatttagacacactgatgaatcacctgagaatgaatatatatatatattagagatagggtcttgctctgtcacccaggctggagtgcagtggcacagttacagttcactgtagcctcaaaatcctgggctcaagcaatcttatttcttcagcctcctgggtagctaggattataggcacacaccaccatgcccaactaattttttaaattttttgtagagacaaggtctcactatgttgcccaggctggtattgatctcctgacctccagtgatcatcctgccttggcctcccgaagtgctgagattacaggcttcacctgggcatattttaaaaatgcaggttaggaccaataagtgaatgtgaaaccagagattctgcatgcttatcaagcttccactaatgccaatgctaacggtctgtggaccacaggttgatagcaagaacttaagaaaacatccaactactggttaatacctgccaaaagtcacagacacttttctgtatgttagcagattgtcatttctaggaagaaaaaacaatatagaataacatgaattaggtaacaatacattaagacaattaagtgccagaagcaatgatgcacatgattgttacttgtgagaattgaggaaaggggacatcaaagtggtaggggagagtattcacctatgataattggttgagagacaattggttaagaaatgtttagttactatcaaagaacagagtgatgtattgaatattcattaagtaatatttcaaacaaattcagtgcctgttacatgccaggtactttatgtatattatcctaatctccctttcaatctgtaaaattgtattattatctccttttgatgaaggagaagagttaaatagctggactcagtacacagctagtaactgtttgtctgttattggagctgttgaatttcaaagctccttttctttctactacaacagtatcatgcctttaagaagtgaatgagtctgactgtggtgtcctctgcttaccagaaatcctcaggttcctccagcctctgaataatttggagtgaacctatcaggtgctctggaaacaataaacaattgatggattgtggctttattctccacttctcatctttcctcagttacactctaactcccctttcatttggggctccaatgttgagacataagcacataatatccatctcttgggcccaagtgatgatagcaggctctagacttccaggtcttccctatcttctgttatccttgtttctttgggccagttatttaatctctgtaaagctcagtggcctcatttgttaatgaacataataatagtatttgcctaatagggctgttaatgaggatcagaagggattgtgtttacaaatatcctaaccctgtacctgacacataataaggactaaatgaatgcaagtgataatagcacatcctacaggattttatcttttccttcaccaacagtgagcaacttgaaggcctcaagtgtaagatattcattctcctatctccatacccaataatattacacaaataaatacatgctttgtaataagtgaactgaccattattccactgagtccagtaaatatccaggtttctagtaaatgctgagcttgcatttagtggtgaggggatgtgcaaatttgaaaatatacaaactctatctttgaggcatctagactaagtgggatgtagttctaatgtaaacaaggttgagtgacatctatttgttgaattaaataattttagatagtaataaaaatagctaccagttttttaccctctcgttatatgcctggcacaggcataattttattttaccctaataccaaccctgtgtgataggtactattttcatccttatttaaaataaaagtaatgtctcaaaaggttaagcaacttattcaagtacaatcagttaaaaagtactataaccagtacttaaatccaggaaaatgtgactccaagactcatacacttttcattgccctctctatacacattgtgagttacttatagaaacatctccccattgctttggtgttttagacatgaagtccttgcccatgcctatgtcctgaatggtattgcctaggttttcttctagggtttttatggttttaggtctaacatgtaagtctttaatccatcttgaattaatttttgtataagatataaggaagggatccagtttcagctttctacatatgtctagccagttttcccagcaccatttattgaataggcaatggcaacaaaagccaaaatgggatctaattaaactagagagcttctgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtggacgaaggatatgaacagacacttctcaaaagaagacatttatgcagccaaaaaacacataaataaatgctcatcatcactggccatcagagaaatgcaaatcaaaaccacaatgagataccatctcacaccagttagaatggcgatcgttaaaaagtcaggaaacaacaggtgctggagaggatgtggagaaataggaacacttttacagtgttggtgggactgtaaactagttcaagcattgtggaagtcggtgtggcgattcctcagagatctagaactagaaatatcatttgacccagccatcccattactgggtatatacccgaaggattataaatcatgctgctataaagacatatgcacacatatatttattgtggcattattcacaatagcaaagacttggaaccaacccaaatgtccaaacatgatagactggattaagaaaatgtggcacatatacaccatggaatactatgcagccataaaaaatgatgagttcatgtcctttgtagggacatggatgaaactggaaaccatcattctcagcaaactattgcaaggacaaaaaaccaaacattgcatgttctcactcataggtgggaattgaacaatgagaacacatggacacaggaaggcgaacatcacacactggggactgttgttgggtggggggagcagggagggatagcattaggagatatacctaatgctaaatgacgagttgatgggtgcagcacaccagcatggcacatgtatacatatgtaacaaacctgcatgttgtgcacaggtcccctaaaacttaaagtataataataataataataaaagaaaaaaaagaaatatctcccccgtaagttctaagtacttatgaacttgagagcctcccacaaatatggctaatattgtatctaaactagcatcatggaagaccatgggccagggactctgaaactgacaaaagctcatttacaaaagtaaagatctcacagcccacatactttatccattcctttaatgggcaaataaaatgtagggataatcaagaaatgtatttacagaagcaaaaatgaggagggtggagtattaaatatacacctactgtaacaacaagagtatggatggattttcctggagatttttaactctccccacagaaacaccacaatgaacaagtatccacaccaaatatcaccttcataagaacaaaaaatcagataagcaaccacactacctggttttaacatcatgtcaggtaaagaggcactgaagtggacagaaaaaacagtctcgaattgtcaacaccacctcacaccaatcctttggcagtggctgtatggcacagagaaagaatttgtgcaataggggaagagagagtgcagtgattgagggacttcgcattggaactctgtgctgccctgtcacagtggaaagcaacactgggaagaactcagctggtgcccacagagggaacatttaggccagacctaatcaaggggaattgcccatcccagcagtcagaatctgagctccagcaaacctcaccatcatgagctaaagttctctggggccttaaataaacttgaaagacagtctaggtcacaaaaactataattcctgggcatgtcctgatgatgttctggcttgaagccagtggaattgggggacatatgacacagttagacatgagccaaggtggcaccacccctctctcaaccctaggcagcacagcttgcagcttcaggagaaactccttcctttagcttaaggagaggagagggaagagtagaggactttgttttgctatttggctaccagctcagccacagtagaatagggcaccagtcagattcctaaggccttcattccaggtcctagttcctggataacatttttagacacaatttgagccagaaggaaacatgctaccttgaagagaagaacccagtccttgcaggatccataacctactgactaaagagcccttgggccctgaataattagtagcaatagccaggcagtacttgctgtgggccttgggtaagattcagagatgtgctggcttcgtgtgcgacccagcacattcctagctttagtggctacaggaaaggaatccttctgcttgagaatagcagagggaagagtaaaggggactttgtcttgcagcttaggtactagctaggccacagtggggtagaggaccaagtggactcttgggatgtctgatttcaggtcgttgctcttcgatggcatttctgttcctgccttaggtcagagaggagcccactgccctgaagggagcgtcctaggcctagaaacatctaccacaagctgactgaagagccctgggaccttgaatgaacttcagtagtagtcaggaagtacttgtcacaggtgtggggtggtggtggccatgaggagtgactcctttgcttgtgaaaatggagggaagagtgggaaagactttgtcttgtggcctgagtgctaacttagccacagtagaatagtgcaccaggtagaatcctaaggtttctgacttcaggccctagctcccagacagcatcttggaacccacccaggactagcaggatctcacctctctgaagggaaagatgcaagcctggctggctttgccacctgctgattgtacagccctagggcctttgagcaaacataggtggaaaccaggcagtggttactgcaggtcttgggtgagacccagtgctgtgctggcttcagatcttaccaaacacagtcccagtggtggtagtgacataggcgtttgtgtcactcctccctcacctccaggaaattcagcacagagggaaacactctacttttttgggagaaagtaagggaatagaagagtctctgcttggtaatgcagatgattcctctacatcttatccaagaccaaggtggtacctctgtgagtctgtaggagccactccattactgggattataatgtcccttaatgcagagatggctgcagtgaccaaaatcttaaacactcaagtgtctttgaacacccgaaagccttcccaagaaaaacaggtacaaacaagtccagactgcaaagactacagtaaatgcctaactcttcattgcccagacactgatgaatatctacaagcatcaagatcatccagggaaacaggacctcaccaaatgaactaaataaggtaccagggaccaatcctggagagatagagatttgcggcctttcagacaaagaattcaaaatagttgttttgaggaaactcaacacaattcaagataacatagagaaggaattattaattctatcacataaatgtaacaaagaaattgaataattaaaaagaattcagcagaaattctggagttgaaaaatacaattgacatactgaagaacacatcagtctcttaatggcagaattggtcacacagaggaaagcactggtgagcttgaagacaggttatttgaaaatgcacagaggccaggcatggtggcacacacctgtaatcccagcactttgggaggccgaggcaggcagaccacgaggttaggagttcgagaccagcctggccaacatagtgaaaccctgtctctagtaaaaacaaaaataaataaattagctgggcatggtggcacgcacctgtaatcccagctactcaggaggctgagccaggagaatcacttgaacccagtaggcggaggttgcagtgagctgagattgcaccactgctctccagcctaggcaatagagtgagactctgtcaaaaaaaaaaaaaaagaaaagaaaaggaaaatgcacagagaagataaaaaataattaaaaagaataaaacgtgcctaaaaaatctagaaaatagcctcaagagggcaagtctaacagttatttagatttaaatacacttaaagaggaggtgtacagagagatgaagtagaaagtttattcaaagggataacaaacaacttcctaaacctagaggaagatatcaatattcaagcagaagaaggttatagaacagcaaacagatttatccaaagagactccatgaaggcatttaataattaaactcccaaaggtcaagtttaaggaaaggatcctaaaagcagcaagagaaaagaaacgaataacatacaacgagctccaatgtgtctgacagcagacttcagtggaaaccttacagggcaggagaaggtggcatgacatatttaaagtgctgaatgaaacaacaacaacaacaaaaacttttatcctagaatagtatatctggcaaaaaatattcttcaaacatcaaggagaaataaagacttccccagacaaacaaaagctgagggacttcatcaacaccagatctgtcctacaagaagtgctgaaggaaattcttaagtacgaaagaaaagggcattaatgagcaataagtaagcatctgaaagtataaaatgcaccggcaatagtaagtacagagaaacacacagaatattctaacactgtaattgtgatgtgtaaactaaacacatcttgaatacaaagactaaaggatgaaccaataaaaaataataattacaacaacttttcaagacatagacagtatgataagatataaatagaaaaaacaaaaagttaaaaagtggggggacaaagttaaagtgtaaattttttattaattttcactttgcttgcttgtttgtttacgcagtgttaagctgtcatgagtttaaaatattgggttatattatttgcaatactcatggtaatctcaaatcaaaatgcatacagcagatacacaagaggtaaaaatcaagaaattaaaacaatattgccagagaaaatcagcttcactaaaaggaagacagaaaggaaaaaaaggaaagaccacaaaacaactagaaaacaaatagcaaaatgaccggaggaggtccctacctatcaataataacattgaatataaattcatgaaactctccaatgaaaagacactgagtggctgaatggatttttaaaaaagcaagaattaactctctgttgcctacaagaaacacactcacatataaagatatacataaaccaaaaataatgaaaaaatatgttctatgtcagtggaaaccaaaaacagcagtagtagctatacttatatcagacaaaatggattttgagacaaagcctataaaaagggacaaaaaatgtcgttatataatgataaaggggtcaattcagcaagaggatatatcaattttaaatatatatgcaatcaacatggaaatacccaatatataaagcaaatgttattagaggtaaagagagagatgggccccagtacattaactgaggacttcagtatctcactttcagcattggacagatcatccagacagaaaatagacaaagaaacattggacttaatctgcactatagaccaaatggacccaatagatatttacagaacatttcatccaatggctacaaaatacacattgttctcctcagcacatggatcattttcaaggatagatcatatgttacttcacaaagcaagtcatgaaacattcaacaaattgaaataatattacatatcttctctgaccacagtggaacaaaactggaaataaataacaagaagaagtctggaaagtatacaaacacattgaaatcaaacaatatactcctgaatgaccagttggtcaatgaagaaattaagaaggaaatggaaaaatttcttgaaacaaatcataatgaaaacaaaacataccaagacctatggaatacagtgaaagcaatactaagagaagttttggctttgagtgcctacatcaaagaagaagaaaaacttcaaataaacaacttaacgatgcatcaaagaactagaaaagcaagagcaaagcaaacccaaaattagtagaaaaagaataataaataatcagagcagagtctgtaatcccagcactttgggaagccgaggcaggcggatcacgaggtcaggagatcgagaccatcctggctaacacggtgaaaccacgtctctactaaaaatacaaaaaattagccgggcatggtggcaggcacctgtagtagcagctactcaggaggctgaggcagaagaatggcgtgaacccaggaggcagagcttgcagtgagccgagatcacaccactgcactccggcctgggcaacagagcaagactctatctcaaaataataataataataataatcagagcagaaataaattaattaaaatgaagaaaacaccacaaaacattaatgaaacaaaaagttggtattttgcaatgataaaaaaaaaaggacaaaaccttagccactctaagagaaagagagaagatccaaataaattttttaaaatcagtgatgaaaaaggagacattacaactgatactacagaatgcaaagaatccttagaggctactataatcaactatatgccaataaattggaaaacctagaataaatggatacattcttagacacatacaacctgagcagaccaatagcaagtaacaagatcaaagccataataaaaagtctcccagcaaaagaaagcccaggacccaatggcttcactgctgacttttaccaaatatttaaaaaagaactaacaccaatcctactcgaactctcccaaaaaatagagtacagaggaatactttcaaactaattcaataaagtcagtattatcctgataccaaaaccagacaaagacacatcaaagaaagaaaaatataagccaatacccctgataaacattgatggaaaaatcctcaacacaatcctagcaaaccaaattcaacaatacattagaaagatcattcattataaccaggtgggatttatcccagagatgcaaggacaattcaacatatgcaaatcaatcaatgtgatacatcatatcaacagaatgaaagacaaaaaccatatgatcatttcaattgatgctgaaaaagcattggataaaattcaacatcccttcatgacaaaaaccctcaaaaaactcggtatagaggtaacatacctcaacacaataaaagccacatatgacaaacccacagctagtatcacagtgaatgaggaaaaactaaaagccttttctctaagatctggaacatgacaaggatacccattttcaccaccattattcaatataatgctggaattcctagctagagcaatcagacaatagaaaaaaaaaggcacccaaattagaatgagagaagtcaaattatccttgttagcagattatatgatttcatatttgtaaaaatctaaagattccaccaaaaacctattagaactgatcaacaaatttagtaaaattgcaggatacaaaattaacatacaaaaataatagcatttctatatgccaacagtgaccaatctgaaaaagaaatttaaaaactagtctcatttataatagctatgaataaaataaaatacccaggaatgaacttaaccaaaaaagtaaaatatctttacaatgaaaactataaaagaatgatgaaagaaatggaagatgacacagaaatatggaaagatattccatgttcacggaatagaagaatcaatattgttaaaatgtccatatttcccaaagcaatttacagattcagtgccacctctatcaaaataccaatgacattctttgcagaaatagaaaagagaatcttaaaatttataaaaagacccagaatagccaaagctatcctgaacaaaaagaacaaaactggaggaatcacattacttgacttcaaattatactacaaagctatagtaaccaaaacagcatggcactggcataaaacagacacacagaccaatggaacagaatagaaaacccagaaacaaatccatacatctacagtgaactcatttttgatgaaggtgcccaaaacatatgttggagaaaatacagtctcttgaataaatggtgctgggaaaaatggatatccatatgcagaagaataaagctatatccctatctctcaccatatacaacaatcaaatcaaaattgactaaatatttaaatctaagacctcaaactatgtgtaactactataagaaaacattggggaaactctccaagacattagactgagcaaaaatttcttgagtaatatactacaagcacagacaaccaaagcaaaaatggacaagtgagactacatcaagttaaaaagcttctgcacagcaaaggaaacaatcaacaaagtgaagagacaacccacagaatagcagaaagtatttgcaaactaccaatctgacaagggattaataaccataatatataaggagctcaagcaactgtatagaaaaaatatctaataatccaataaaaaataggcaaaagatctgaatagatatttctcaagagaagacatacaaatggcaaacaggcctatgaaaaagtgctcaacatcactgatcatcagagaaatgcaaatcaaaactacaatgagataatctcacctcagttaaaatgtcctttatccaaagataggcaatacaaatgctggggaggatatggagaaaaaagaatccttgtacactgtcggtagaaatgtaagttagtgcaaccatttcaaagaacagtttggagattcctcagaaaattaaaaatagagctaccatatgatccagcaatcccactgctaggtatatacctgaaagaaaggaaatcagtatatgaagagacatcttcactcccatgttaattgcaatactcttcacaatagctaagatttgaaagcgacataaatgtccatcactagatgaatggataaagaaaatgtggtacttatgcaccatggagtactatgcagccgtgaagaagaatgagatgctatcattttcaacaacatggatagaactagaggttattatgttaagtgaaataagccgggcactgaaatacaaactttgcgtgttctcacttatttgtgggaagtaaaagttaaaacaattgaactcatggagacagaggatagaataatagttaccataggcttagaagggtattgtggtgggggagggggcacgataattaataggttcaaaaatattgttagctagaataaataagatctagcatttgataggacaatggggcaagtacaattaacaataatttgttggacatttaaaaataactaaaagactatagctgagttgtttgtaacacaaagaaaggataaatgcttgatgtggatggataccccatttatcttgatgtgattgttatgcattgtatgcctgtaacaaaatatctcatgtactccataaatatgtatacctactctgtgaccagaaatgttaaaaattaaaaattaaaaaagtatatgggtgatttctacctcaactgcagcacatatgtgttgagtatcaattggaaaataagtcaaaaattatgttaatgcaccagtatacaccgaatgattaaataatccaagaaataaataataaatcttagaagtattcataatgaactcttaattctttattaaactgaaatctatgaagtcttgtgtcatttatctgtaacagtaaaacaaagtacttgcatatttgaatcagttatctggccattatctggactttcatagcttggcactgagccacaaatcatatactgagaattactttcatgtaaccttgcaacagtgatcaaaattgaggtctgtgtcatctgatccaaaagtcgctttgagttcttaaatcagacaacattcaggaggcatgaagaccaatattgtgatatattttattataaggaaaacatggtaaggtcaccaagaaaagcctagacttgaaagagaagagcaaaatcaggccatgaaattaggcacttatctcttaatgcaactatcaatatgtttttattactaaaggtaacaattctgaagtacttattttgtaccaggaattgtgctaactgctttgcatatattgtcttgtataaacttcaaaacaaaccaacaaagtagttactgttatccatacccagtttacagctgagaaactgaggcttaggaaggataagcaactcctttcaataccacttagccaataactagtgaaacaagattttggacccaaagtccatgctcttaatcactgtattccatcattgtattccatgtttaatgtactattagttaatgtctaccacagattagactgcatcttttgttatgaggattattatcaaacttagatccttttgacagtagaaggaggcatgattaataattttgttgggcattcacaaggactgtcccaggcaaacaaggatatatgtaatcctatttaataactttccaatctgcatcctgacatgatacatacacagcaagaattttaacatcagtttgtaattgtaattgggtgtacaagttagattgtgtaccacaaacacctgcagggtaaccattgtgatatataatgatgtgttaacagacctctagtgcactagaagaaaatctattttcctggcttgaaagggaccaatgaattgtatgggtccaaagtggtgctttggggctatgtggagcaagtttgcactgtgaaatttcacagaggcaagaacctttatgttaacgaaaaaagactggtacctctttacaaagccagttcccagtgcccctggccctgcaggaaagcagttctactaaacaggtgacagacacatctgcagcaatggatctttagcctgggtccaggctgaactaggatgtcagagcaggtctggaggcaagagatgggtggtagagacattgtattagtccattctcacactgctataaagaactgcctgagactgaataatttataaaggaaaaaggtttaattggctcacagctccacatggctggagaggcctcaggaaacttacgatcatgacgaaaggggaagcaaacatgtccttcttcccatggcagcaggagagagaagtgcagagcaaaagaggaaaagttccttgtaaaaccatcagatcccatgagaactcagtcactatcatgagaacagcatggggaaactgcccccattattcagttatcttcacctggttctgcccttgatacatgtggattattagaattcaaggtgatatttgagtggggacatagagccaaaccatattaggcatagaggtttgatgggagagaacagagcaaaatgaggctgcagggctaagcagagctatcctcaatggcggttatgcagattcccttcagatattgatctttttataacttacttttattaactgaaaaatgaacttttaaaacctttgtactccaatattctttgaaaccatcataaggcatagcacttaatctctcagagttgaagatttctaccttcattcaacaaatatttcttgagggcccattaagtgttccaggaagtcttccaggagctggggatgagtggtaaacacaacaaattctctgacctcattactgagtatgtctgaaggcttttatggaaaatgacacttttaaaaacgtatataaacaatgtttttccaagtcatgaaaattatatcccctctttagccctcagttccctcaagtgcaaaataaaggcattgacctggctacctttccagggctcttccaactctaaaatcctatggccctactgtcactttcttcaggttggtgtgaaggacaatgcctttctttattcagcttttccaatcttagtgttaaaaatataaattcatctcaaaacagcacaattcaatattttttatactcagaatgcaaatcaaaagtttaaacacatatatcaactgaggagctaagcaagaagtgtagttatgcaaccaacatgtaagacacccatccagtggcctcctctgaaagctacaccagaaagacttactctttctgaagagcaatcttggtcagataattctttgtgggcgttatgtgaaccaacatttcagagaaaccatacaatggcagggcactatagttgaaagtgaaattgtattttccttcttactattcttgcatcagaaatggagaaaaggataagagtactgctcctttccagaataagaagaaaattagcctatttcagaaccaggactggtaacatttggaaagctaatatagggaagggagagagaaaatgaactttaatattcccatcctacacgtcaacattatgccatgacttacatgcatgacctctaagcctcacagggagttgacccggtaagcattattgtcttctgctgtaagataaggaaactagggatggaagaggccaagtaattgcacattattaagtagatgttatttgagtccgaagccacactctttccaggtgctctcctttttgggataccctaacatgtttaatccagtttagaaattccaaatttaattatatattcacaatttttactgttggctgttcatatgtaaccttgtagtattgctatattatcaacaacatatagaagtgctcctgatcactgcataaatatgcagcaccatgcccagtacgtatagatgctcaaatatactaactattctcctagaatcagtgttccccaacctttctgtcaccagggaccggttttatggaagacaatggaatggtatggggttggagggcagggatggttttgggctgaaactgttcaacctcagatcatcaggcattagattctcataagaagcatgcaatgtgtatcccacatgtgcagttcatgatagggttcatgatcctatgagattctaatgctgccactgatctgacaggagctgagttcaggcagtaaagcttacacacctgccactcacctcctgctgttaggtgatcataacaggccaccaatcagtactgttctgcagcccaggggtcgcagactgccttaaatgattatagcctatgttttcttaactaggctaattaacattagtgaagattaatttgttttgagatcagaccagcagctaagccaaatgaatgaggaaacagctgatttggcaccagcatgttcatgaagaatgaacagtctatggattcagaagctaaattatatatgtactgaatattagtttgggcacttaatagcaacatgactttggcaaattactccaactgagtgtctgtattattcactgtaaaacaaggtaaataatgcattgctggatattttgtttaacttttattttaggtttgggggtacatgagaaggttcgttatataggtaacatcatatcacgggggtttgttgtataaattgtttcattacccaggtattaagcctagtacccaacagtcatctttctactcttcttgctcctcccaccctctaccctcaagtacaccctggtgtctgttgttcccttctttgtgtttatgagttctcgtcattgaattcccttctataagtgagaatgtggtatttggttttctcttcctgtgttagtttgccaaagataatagtatccagctccatccatgttcccacaaaagacatgatcttgtttttatggctgtgtagtattccatggtgaatatgtaccacattttctttactcaatctgtcactgatgggcatttaggttaattccaatgtctttgctattgtgaatgattgctagatatttgtgaagattaaataaaaatatacaaattaaatattgaaatgaaaatattactaaacccctagtacagtgcctggcacatagtaagtactcaatattgttattactaatttaaggtaacacacactttagtaacaaaaatgttatagaaaagaaagaacagtgatactttcagtgcacatgccgaagatctacttttgttttgctttgctttacagctatattcatattagtaaaaggtgctgatcagagtataatgggataaaacctatttgatggcaaacagtcaaactgatggcctccaggatttcgcataatctagcccctcctatctctctgaacttatttcacaccagtgcccttttatttaatattcttgggcatttttaatatttccccaaattctctaatcctaggatctttgcatcagtgtgccctcttttccaaaatcttcacaaagctcgtgctttctcactatttgagtctcagagcaaatgtgatctctctacagaagcctccctgactacgcatcttaggtcctggctccacctccatccattaccatctaccttactaattttattcacagcatttatcattatctgaaattattttatatatgtatttagtttcttgtttactgtccattttcacccagtaaaatgtcagttctatgacatagacatcttattcctactttggtatcctcagagcctacaacagtgtctggcacataacaggcttttaaattcttgctgactaaataagcagactttcattttgttgttcatactttcttgaattgctttattctactggaaggaaatccataaatatttttgctcatttaattggattttttccactttctaatcccccaaacattcaataattcatcaacatccttgagtaaatttaaatttggattgatttctacatttaaaatctggatttagtatttttagtagaagaattcaatggaagtaggaagccattaattgtgcaacttctcagcatctgatgcatgcatatggtgtggctttgtagggcttctgggcagggcattaaattatgtgacaataacagaataccaataacatacctgaggctgcatcagacaggggatgatctgtttgtgtgtggttagttctgttgctccgtcaagggaaagcagcctttagctttgtgaaggccaatgtggatccctgacagaaagctgcagtcagacactatcacattttaagaaaaataaactctgtgatgattctggccaacctcaatctgtaatgtggctgaaaatgaacagaggttgggtgttcaatttcaggccaagaaagcttccgcagcactggctattacaagtgtcatatttcagtccctttggttcacttcacttggcagaatttgttcaagacaagtctggagtgatttatcctgttcactaatgagttcttcctccaaaagagaagttcctcccaagctggggtccaagtcattagcacaaggatctggaggactgctcagagcttaggagactcaattggcagaagaaatttggggttccaaatcagccaattgtaaagagtcacgcaatcactcgggatctcataactctgatacaccgatagaaaagtatttcttaaattttaaaattaatctttatccatggtaagcatacgaattatacagtcttggagactggaaaatagatttaaaaaccaatcccacccacctccacaaaagcacattctcaagagataaccactattataagtcttcttggcatccttctaaacattttctagatatatgtgctcatgcataggtaaatagacggatagtgataggaccaatcaaagaatacgattcctcaacttacagggcatggcactctgcaatgatggccctaattcttcactccttcctgtaactttgcagtgctttcctaccatgggtagttgacctgctccatcatttggcattgagctcagccacgtcaaatgctttggctaatgggatgttagcagaattgaaagagcagtggtttgaaatagtgttgtgcattggggctgctctcttgaacctctactgccatattaagaatttgtctcagctcgcctgccagggtatatgaggcacatggagcagagctgagtgatcccagtcaccccagcccacaccaaaagcctgccaacagcctgccaacaacattcagatatatgagttgatcaacaaagatcaacaaagactactagctactccacccacatttgaccccagatgcttggggaatgaacacattgttgtatggccactgaggttggtagttatttgttaagcaacattattgtgacagtaggtaactaatacgtatgtcttagagcttttcccatattggcacaaaaagacctacctttttgttttcactaactgcaaaatattccattgtgtgtaagtactgtaagtgctctgatttagttaattcatcctctgttgacaggcatttaggttgtttccagctttttgctagccaaacaacactgccaaggacatatcccagatagatatctatctagatatctagacttggcacactgatccaaaggatacatttctagaggtagaaatgctacatcaaaagatgcgcatttcaaattttgctaactattgtcataaaaacttgcttctaaactgtctgtgcaggtcaccatctaattttaaggacgagaaaggtttctagcctcttctaaaactaatgcatctttttgaaagaatgttacaggaatttgatatttattaacttctaaattttactaacattataatgtttcttgtcttcaaagtatacaaaatattgactattgtcatcactatgttttgatatacagagccttttctttctttgtttgtttatttctgaatacaagaagttatatcctcaaggtcagacttcattagctctgacggtctggcttgggaaattcccataaaggactggaagtgcagggcttcagctctaagacttggtgatagcctgaagcctcagggggaacagatggcagaatcagtaaccaccaaactacctctcctttcataaaattctctcctctttgatgttaggtaatgaaaagaacgaaggctttggggttccccagaatttagtttgatcagagtgttgccttttatgtactgtgtgggtttaagtatgctatagaaattcatgggcctcagttttctcgcccatgcaagaaaatggtgatatttattgttttgtgaaatctagtccacttctcatatctgttgctccttgcaaacaaaaaaaaacatgaggcagctgctgggacaactcacatctcaggaatgaggaagcatattgaagtgaaaagagcaccacgaacttgtgtttaaaggctcacagtgcatcctcctgctgaccttcctgagtgaccttgtgtgtggtcagttaatctctctgcactttgtttcctccattgtgaatggggatatgaaatctgtcttgcagggctggagggaggactagaggtgctgtgtgtgaagcacctagcacaaggtttgacacacagaggactcccaatagtggtacttcttagtacttttatttgtgtggctctcctgaccataaatgagtggttgtgttgtcattttacctcactcttccccacttcccacagtatttaatctaatttagggagcacattctttctccacattttcacatctctggaaatagtctgtggcttaaaattgatgatatctggctgggcacgttgactcacacctgtaatcccagcactttgggaggccaaggcaggtagatcacctgaggtcaggagtccaggaccagcctggccaacatggtgaaaccccatctctactaaaaatgcaaaaattagctaggcgtggttgcaggtgcctgtaatcccagctactagggagtctgaggcagaagaattgcttgaacccaggaggcggaggttgcagtgagccaagatcatgccattgcactctagcctgggcagcaaacgctaaactccatcttaagaaaaaaaaattaatgatatcttataattgtggacagccaggtcacagtcataacgtaattgtcattgcctgtgcatgcaaaaactcggtggcatgactggacaactggaaactttctgtgtctcactccaaagaccatttaaggaccatttgaggaaggtctaaaatttctgcctattgtctgaaaacttattatttccactactgctattttcatgaccatccgttaagagcttaacaggtgaaggaatctgggctaagaaccagaaatataaagcccttgagggtcttaaatatcaccagggaaacagggcatagatttaaaatgtaattaactctgtgaagcagtctgtggctgatgccaggcaatagtgcagacactatataaatgcttcagggggcaaagacaagagaaatggctgggagggtgaagattcagagacagcctcgcaaaagagaaaaaacatcaggaggctttgaaatgaggattggacttaggggaaaagcgcgatctttctggaatggaggatggttggaacaatggagcagtggggaaaatacctgaagagtattaaaaaatagaagcaccctctttagattgacgcatcaggttcaccaggtgaagggaatagggtggtaaataaaccaagagttaggaacaggctagacaatgaccttaaagtcaccttggatgtccctccttatttttaattcataagttaatgatgtgaatgcttgtggatgattgccatttaggccattgagaataggagggaaatttcttcttcatggatgatttgatctgattgttcagaaccagaagaggtctcaaaagacaatttgtcctgctatctgattattactggaaacaatggcataattatcaaccactcagaaatggagagcattatttttggcagatgtcttttaaatgtaattggttcaatttcataaccccaggaagctagtcgatttatttggttactgagaagctttattgagacatttctatggccacagtgggcaattggtaacacctgctttgaggatcacatgagccagtattatcctggccatatggtgtacaacttttaagacataagcaattatttgtttatggattagattcaggcaatttcttaagacaagcctgcctgatgctgagaaagagagcccatccaactgaaagtttcgaaaacctcattaaagtcttcaaatgttcatcaaggatgagactgatctttgcagtaagacctgagaccatgaccaagatattgaaagttgcaacctgctctcattccccctatgatcctgcattctctagacatctttacctgctgtgttgttggttttgttacacagaatttgtcaccttttgatatactatataatatacatatttactaaatttattgttcattattttcttacctagctggaatgtatattttacaagggcagtagttttagtctgctctgtgtattgctgtatcatggaagtctagaacagtgcctgaactttacaaacttcaaatatttgaggaactgtcacttggatgagtgctttcatcaagaggaatcctgggatgttgtggaggagactatcatatactcctgggataagttccgtatctggatctgtggctttgctttttctttactctaggaatctatgactttatactatgaaaaaggagaacaaataaagttaaaatatgcttaacattggttgaggtgcaacatgtgtgtagcaatgtttcacagatatgtctaatgccaggggaggtcttttcacttgacaaatagcctggatggtgttttggtttacaaaagctggcagaaatagacgtaagcctaatcttatgtctttgatttacaaaagtgactctttctattgctcttcaccactggagtttgggattgggactatatattctggcaaagtaatcaaattggatacatcagttcatttgctggatttcagcttttacaagtagttcctaaccctccaccacctatcttcattaattaaattcataccgagcccactgtatgtttctctcaagcccctcaagaacacaattaagtcatgttgcaattttttagcaccatgatacttcaaagagaggtcggggaaagaaagtaagttaagtgaaaaaaacttaaataaaggcaagattttccagtgttatcttctgaaagtgaatggcatatatttatgtgagagttgcattatattttgttatttagttgctaaatttaaattccaatggtcattttcagcatttcctctgtaagggaaaacattctgtagatattttgtctggtgtgcttttcaatatattgtgtgtggttagtaatatgctaagcagaagtctgagggtgccttattttatttcatcaatggattgctaggtaggaaatgaaaaggatggaagcatgttacccacttatccactaacttaggttttttgaaaaactccttgaatttcacaaaaatctcccagtttatatcatttttgccaaatatatctagcaaatgctttgctattctaagcaagttacacacccgaaataaggggtatctagcaacttgaaacctagctaaactaatattagtgaatcaattaatactactgtttattaaatcttttattgacatttgttgtttaaaaagtgcacagatcccaagcatgcagctcagtgaattcccacaacctgaatacacctatgcaacaacacccagatcaagaaacagaaaaatgtcagcagttcaagagcccttccaatcactgcccaccctccaagatgaaccactaacctcagcagtacagtatggattagttctcccttcttttttgttctttatgtaaatggaatcatacctatgtactcttttgtgtttggcttcatttttcttatatctgtgagatatatattctgcattggatttataaagttagaggtcacttattctcattgctgtacagtattccattgtgtgggtataccaaaatttacttgtcttttcaacactcattgggcatttgggcagtttctagtgaggggctattgcaaatgctgctgccatgaacattctagtgcatggaattatggtggaaacatgtaggatattctattagttacataagagtagaatttcaggttccaacacccttctgtaagtgacctgattgttctcccaaaagaaaaacatacaaatatgcatagatgagtaaagaatatgtcatggcagggggaggagccaagatggccgaataggaacagctccagtctacagctcccagcgtgagcgaggcagaagacgggtgatttctgcatttccatctgaggtaccgggttcatctcactagggagtgccagacagtgggcacaggtcagtgggtgcagcgcaccatgcgcaaggtgaagcagggcgaggcattgcctcactcgggaagctcaaggggtcaaggagttccctttcctagtcaaagaaaggggtgacagacggcacctggaaaatcgggtcactcccacctgaatactgcacttttccgacgggcttaaaaaacggcacaccaggagattatatcgcacacctggctcagagggtcctatgcccacggagtcttgctgatcactagcacagaagtctgacatcaaactgcaaggcggcagcgaggctgggggaggggcgcctgccattgcccaggcttgcttaggtaaacaaagcagctgggaagctcaaactgggtggagtccaccacagctcaaggaggcctgcctgcctctgtaggttccacctctgggggcagcgcacagacaaacaaaaagacagcagtaacctccgcagacttaaatgtccctgtctgacagctttgaacagagcagtggttctcccagcatgcagctggagatctgagaacgggcagactgcctcctcaagtgggtccctgacccctgacccctgagcagcctaactgggaggcaccccccagtagggacagactgacacttcacacggccggatactcctctgagacaaaactttcagaggaacgatcagacagcagcattcgtggttcatgaaaaaccgctgttctgcaaacaccgctgctgatacccaggcaaacagggtctggagtggacctctagcaaactccaacagacttgcatttgagggtcctgtctgttagaaggaaaactaacaaacagaaaggacatccacaccaaaaacccatcaaaaaccaaaagtagataaaaccacaaagatggggaaaaaacagagcagaaaaactggaaactctaaaaagcagagcacctctcctcctccagaggaacgcagttcctcaccagcaatggaacaaagctggacggagaatgactttgacgagttgagagaagaaggcttcagatgatcaaactacgaactacaggaggaaattcaaactaaaggcaaagaagttaaaaactttgaaaaaaatttagaagaatgtataactagaataaccaatacagagaagtgcttaaaggagctgatggagctgaaagccaaggctcgagaactatgtgaagaatgcagaagcctcaggagctgatgtgatcaactggatatcagtgtatcagtgacggaagatgaaatgaatgaaatgaagtgagaagggaagtttagagaaaaaaagaataaaaagaaatgaacaaagcctccaagaaatatgggactatgtgaaaagaccaaatctacatctaactggtttacctgaaagtgacggggagaacggaaccaagttggaaaacactctgcaggatattatccaggagaacttccccaatctagcaaggcaggccaacattcagattcaggaaatacagagaacgccacaaagatactcctcgagaagagcaagtccaagacacataattgtcagattcaccaaagttgaaatgcaggaaaaaatgttaagggcagccagagagaaaggtagggttacccacaaagggaagcccatcagactaacagcggatctctcggcagaaactctaaaagccagaagagagtgggggccaatattcaacatttttaaagaaaaggattttcaagccagaatttcatatccagccaaactaagcttcataagtgaaggagaaataaaatactttacagacaagcaaatgctgagagattttgtcaccaccaggcctgccttaaaagagctcctgaaggaagcactaaacatggaaaggaacaaccggtaccagccgctgcaaaatcatgccaaaatgtaaagaccatcgagactaggaagaaactgcatcaactaacgagcaaaataaccagctaacaccataatgacaggatcaaattcacacataacaatattaactttaaatgtaaatggcctaaatgctccaattaaaagacacagactggcaaattggataaagagtcaagacccatcaatgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcgcccaacacaggagcacccagattcataaagcaagtcctgagtgacctacaaagagacttagactcccacacattaataatgggagactttaacaccccactgtcaacattagacagatcaacaagacagaaagttaacaaggatacccaggaattgaactcagctctgcaccaagtggacctaatagacatctacagaactctccaccccatatcaatagaatatacattttgttcagcaccacaccacacctattccaaaattgaccacatacttggaagtaaagctctcctcagcaaatgtaaaagaacagaaattataacaaactatctctcggaccacagtgcaatcaaactagaactcaggattaagaaactcactcaaaactgctcaactacatggaagctgaataacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttaatgaatccaggagatggttttttgaaaggatcaacaaaatagatagaccagtagcaagactaataaagaaaaaaagagagaagaatcaaatagacgcaataaaaaatgacaaaggggatatcaccaccgatcccacagacatacaaactaccatcagagaatactacaaacacctctatgcaaataaactagaaaatctagaagaaatggatacattcctcaacacatacactctcccaagactaaaccaagaagaagttgaatctctgaatagaccaataagaggagctgaaattgtggcaataatcaatagcttaccaacgaaaaagagtccaggatcagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagaaaattttagaccgatatccttgatgaacattgatgcaaaaatcctcaataaaatactggcaaactgaatccagcagcacatcaaaaagcttatccaccatgatcaagtgggtttcatctctgggatgcaaggctggatcaatatacgcaaaccaataaatgtaatccagcatataaacagaaccaaagacaaaaaccacatgattatctcaatagattcagaaaaggcctttgacaaaattcaacaatgcttcatgctaaaaactctcaataaattaggtattgatgggacgtatctcaaaataataagagctatctatgacaaacccacagccaatatcatactgaatgggcaaaaactggaatgggcaaaaactggaagcattccctttgaaaactggcacaagacaggatgccctctctcaccactcctattcaacatagtgttggaagttctggccagggcaattaggcaggagaaggaaataaaggctattcaattaggaaaagaggaagtcaaattgtccctctttgcagacgacatgattgtatatatagaaaaccccattgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaatgaaattagagaatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcaccgagtcaatcctaagccaaaagaacaaagctggaggcatcacactacctgacttcaaactatactacaaggctacagtaaccaaaacagcatggtactggtaccaaaacagatatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacatcttattcaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaagctaccgtcagagtgaacaggcaacctacaaaatgggagaaaattttctcaacctactcatctgacaaagggctaatatccagaatctacaatgaactcaaacaaatttacaagaaaaaaacaaacaaccccatcaaaaagtgggcaaaggacatgaacagacatttctcaaaagaagacattaatgcagccaaaaaagacatgcaaaaatgctcaccatcactggccatcatagaaacgcaaatcaaaaccacaatgagataccatctcacaccagttagaatggcaatcattaaaaggtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacagatacacacgtatgtttattgcggcactattcacaatagcaaagacttggaaccaacccaaatgtccaaccatgatagactggattaagaaaatgtggcacatatacaccatggaatgctatgcagccataaaaagtgatgagttcatgtcctttgtagggacatggatgaaattggaaatcatcattctcagtaaactatcgcaagaacaaaaagccaaacaccgcatgttctcactcataggtgggaattgaacaatgagaacacatggacacaggaaggggaacatcacactctggggactgttgtggggttgggggaggggggagggatagcactgggagatatacctaatgctagatgacgagttagtgggtggagccactagcatggcacatgtatacatatgtaactaacctgcacattgtgcacatgtaccctaaaacttaaagtataataataataaaaaaaaagaaaatgacataagaaaaaaaaaaaaagaatatgtcatggcaatagaatccagtgatagtcataagctcttgaagatttcataagagactacaaggttttcatagggtcccctacttcgtgctatgaagaatacaaattccttatctctcccacagagagatgaggtgggggtaaatcttcccatcaccaaaaaagccacagagaactttactttccaaaatcaaagcatctaagtgacaagttagactgttgcttctcattccaataaattatcctatttgtatttgcctttctagcaggcaccaaggagagcagggaaccataatgaaaattcatgcttgcaaatcaccctccaactgtaaagtattttatggatattaactaattaatcctttacttctttcctcctgtttccccaccttttctccccaccatgaagcaggtggcatccccatattgtgtcactcatttgcaaaaagataaacacaagaacaggttatgccgtatcatttatgaggtccaacagtgtaaaataaatacttcactgcctggggccttcatgaaataaaattaccacatactttgagcctagagctctaaattgcacagataaagcctctgaagaatttttatcccatatgacaggagagatggattcgttgttggatttatttactaaactgtcacagtggttgctcatgaatatcaatgatttgatagctcctgaggaagctgtggaagagccttaagagggaaaaattgctaaatgtttctgaacatgggactgagcaaaggtgactaaagtggttactctcagttccccccattccactacaatccaaacagaaaatttgaaaaattgtttagaaaaggatgcataggtgaaatgacacttagatttgtaaatatagagaaaaagtgatgtctgttcctgaatgtgtttgtgattagaaatgggcatctgattaggaatttctgatttttaaaaaataatcagatttcatgtaagctctggttgtctgtatttagatattaaccaccaattaaatttggtttattattttctaatggaaaaaaagcctaggcatgtggaaaatttctctcattttatatttatgatgcacaaaaatggagtaatctacttttaattttagatacaacctacctttttaaaatcaggaaccagaaaagtaatcagaactagtgattataccagacaaaaaagaattcttcctgaggctacgttctgctctggttctatgctctccacttactctggtttcccagaacttttttgtgcatattgagggcactggaggttccttggggcattgaatagaaaaagggagagagagagagaaacaagttgttattaggcttgataggtttgttcaaaagagaaattaagatacttaatatttgatttttttctacccatctagacactcctggggtgaaagccccatgtgagaaatgactaaagaaaaataaaacagagccactgccctcagggactctacagataggggcagggataagtcaagtaggcatatgtctaaagcatgagatagagcgggcaagtggtctgcaaaagagtggactgatctgctcaagggggcccacatgcccgtcccccatgatgtatagaaatgcccctcaatagtaacacatttaccaaaatacagagcagtgctccaagcaggccagggatatcttgagatcctagaaatgaagagggactcaaagctggaataataagctggagttgaagccaacatgtccaaggaaggaaatcgaccttaggaccaggaccttcaataccagtttgaggtacacagtgagcatctcctatggaaaagggctcttatgcttttaaagagaatttgagaagtagagcatttaattcagcgaggaaaaaaacaacacaaaacaacacaaaacaacacaaagaggtggaaccacaaaggagctaggagaggaccagaagtgaagtgggcaaagccaggaaaagaggccttaaaggtcgagggagaatcagtctgagaggccatcggaagtgtccttgatgacgtgtgtgtgggagggtgtggtgggggagtgctcaaatggaagtagctatgagggagtagaggtagctgagacagaggaggtataaaaggtgaggggaaaaaaaaaggcagaaaaatgcaggagtagccagcctgaatagagttttattttctgatggttgtttttgttgtttgaggataaaagaggtgtttatatgtttgtaagcaaaaagtcaaagacagagggagtgagaggttgaaatccaaattactataatagaggaaaaaccaggaggaagcagaaaagattggactcaaaaagtaggtggggttaacaatgaaaaggagtaggtatcctggctaagatggtgaaaccccatctctaccaaaaatataaaaattagctgggcatggtggcacacacctgtaatcccagctactcgggaggctgagacaacagaatcacttgaacctgggaggcagtggttgcaatgagctgagatcgggccactgcactccagcctgatgacagagcaagattccatctcaaaaaaaaaaaaaaaagtaggtaaaagcaatgattttcttatttatcattcatggtattttattatgtttgggcattactattgctgatggaagtctgcaaaatgagatgtcattagttttaggtcatttacctttttatcttggcattatgttaatgagttttgcttaacaaatgattctaaaagcagtagtataaaactataagcatttattatctcaaacagttgctgtgggtcaggaacctagaagtagcttgtatgggtggtctggcttgggctctgtcatgaggctacagttaagacgttgactggagctaaacgtttgactgaggctggaggatccaagatagattgctctcacacaacagaagttactgctggttgttggcgggaggccttaggaactctgcatggacctctctatagggctgcttgagagccctcacaacatggcagctgccttcctccagagtaggtgatgtgtgtgtgtgtgtgtgtgtgtgtgtgtgtgtgtgtgtgtgtgtgtgtgtgtgagagagagagagagagagagagggagagagagagagatctcaaatcctttaatgacctagacttgaaggaagtcacaaattatttagtggaagtcatacatgttcacttctactgcattctgttagttagaagtacttccctatgtagagacacactcaagtgaaagggaaccaggctctaccacttgaaataaggagtatcaaggaacttgtggacagcttttaaaactaccactggcaactaggtcttgaggtggataaatgaagaaatttggggaatctcacactggagatgtttgatgtagttaaatgatctgagattcattaggtgtgaaataatgaagtgtatatatagttctgcatatacatgcctgggaaggtataatattcagagcatactatcactcaattgtatctgctgtggcctcagacagtacagggcagtgtttgcattgataatagaatgggaaagggagggagcggatgcatcagtggctccatgtgttactccatttctttgcagatttcctcagtgagtcctctttgatgtagtatgttgcaggagaaacaatgatatgagtcacagagtttctgtaagttctgacctcccttgtccagctgcttagagtagggcagcccttgtaaagtaaaaagagccagatttgaggtgaagcttctaacatagcacaataaaaagagaagaatttgcccccagttttgttaccattttccttcagcgcacttggaaggaagaaggaattaatgaggctcattgtgtatgcaagggtaagcacagtttgtgttgagctgagtctagcagaagctgaaaaagcatatctggcacagctaagtaattagacttcacatttctcacattttgtaaggaaagaaaatgtctttagtgggaagcgtctttaaactcattttccacggacagaaaagactttctaagcccaaccctgggcttggtcctttgtggaccacatttaaaatgaaggtagaaattaatgtagtcatgttttaggttatttgtatgctctgcaagaaagggatgaccgcttaagagcagggctggtgccaggttcctgactagaattaaaatccaggaaaatatctgtctagatcaaatatagaaatcagggcaatgatgaagacatctatttccattattctcaaatgactggaaatacctagaaaacaatgatcatgtctttcatatactgattaaaatatggtctttggagccagatttcctggattcagttctgactctgccacttaatagctgtgtgatttgacacagtcgaaattaatttcctccttctctatctcagttttcttgtctgtaaaatggggaaaataagagtacctgctgcaaaggactgctgtgaagaagtagataatatatgtaagtcacaaaaacagtgactagtgcattataagaactgcaaaggttagcttttttatgactcttaattattactaagaatagttgtgcaacaagtaggtgccgaataaatatttgctatttgaactgagcactaagactgataaacacctgtccccattacagcattagctactgcatccactgcctgcctccatgctctagtaacacttgtagttatagtacttgtcacactgtatcataattgtggtccacatctgtctcctccacttgaactgcaattattttaagggtagagtgcatgtcttatttatctctttttcatcagcatttatctcagtgaactctataaaagttcacaataaatgtttgtggatatagtgattaattaaaattaatcagcaacattcattaggcacctacgatgtgccaggcacattgctagttgcaagaatacagcaatgacctagacagacactatctttgctttaattgagtttaccatgttgtagagctgtttgcagaatcctgggtccctctgggacactgagagagagaggaggaaggcaatacataatgtttgctgatgctactccatatcaattaagatgtctaagacagcagatagcagaaaacccaactaatagtgacctaaaccttaagacacatatggttccagtaaaaaaaaaagtctggtgttagatggttctgaagatggttcattagctctctgttgtcagggtgataggttagtgtatcagcaattccactgggtttcccctaaaggtagcaagatggttaccaaagctgcaggcatgtcctcatccccatcatctccaaaagcaggaggcatgaggaatttccatgtgcctgtctccttttaataggaggaatatcttttcccaaatctctccagtagatctactttagatcatctaagatgggatcacatggcattctcatctttaaagaaggctgggaaattgagtttctattttgtttagcctgtaataagttgcaagaggaaaaagtagtgggaatggctttggggtagtcaaacaactctggctactcttactcttcttgtttcccatgacctaaaaggaaaagaaagtgtgagaaggcattgtgtgattctctgcactcaacctcaccctgtcctccacctgtaaaatgatgagatagaataggtggtccttgagggtccattcagcttttctttttagagtcagttatctatgaccacagaccatggacagcaaggcttgatcacaagcagctttcatttctgtgcataataactatgttccagatactgtgcacactttaacactcatttgaacagaaatattaggagtcaatatgtctgggttctagtcagagccttggattttgacaagtcacatgtcttctccaagcttcagagttatcatcatttaaatggagataattatgcccaacagcaaggttgctatgtgggttaaatgtgatattccgtgtaatttgcattttgtttatagcctgattagtttcacagaggatttgaggtgaatgttctttgtaagttgttgttattattattacctctttacacaattctgctatccaaacaaccatatcaaagtaacagaacattcaaaacaagccccaaacacttcatcctgcacctacagggataagctctagccctcatatggaatcctggaatcactgctatcagagttgtcagttttctccccataggtgccagcacatgagctcttgttttagtgtgtcaccttgggtttctgggatcttcaaaatgattgaatgtgaaccagtaaaggcaagtgaagaactttgcctttggcgcctcacaatttcaaggttcattcataacagaaggtacattcttgcagacattatgcatgtaaatgtagttcttcattaatcttgctaaatatttgaaacacgctaataagaccatgtttgtgttcagttgtgctcttggaaatgccaccctctgcatggtgtcatctccctaggccaagtgtgtgatgctcctcatgcaaagcaggtgagagtttctctcacacaagactcaaatacttggagatatttgagggaaggtaggtgggtaataatttcctaaaatctaactcaatttctttcagagcccaagtttattgaatcttatcacccagcaagagatatagacagccaggccaaagggaagaagagccaattaatcctgtttgcatgataagaacctcctaagtgtgtgtcttaaatgatgagatctgacagctcagcctgaaagcttcagctggaaaatgatagtgaacagaaagctgctgaaaatgctctacaggtgtggtcacccaaagtaaccccacaatattgctagtgatttaatcagcattggtatccaaataatcatgctggaattttccacacacccatgcacactcttgcactcaatcatttaatcatttatcttttccaatcgtttaagacgaagtgtgcatgaaaagtagtagtgtaggctttgcagtcaagcagagctgggcttggatcttttcagcacctactcattggatgatatttacatttttgtgcctcagttttctcatctgtaaaatgagataatacctgcttcagcaggttgctttgaggattaagggaaattaactcctagagagaatctagcagagaatttgtctccatataaagtgatcaataatagtcccttcctttccattctcactggtactagaggagctttgtaccttttcttggctgcattcatcttctttttccaaatactaatggctgaaataattaatttttggcaaacctaatgaatgccccagttatttaattggtccttaaacttggagggtagagtctatttagaccacaatacagaaaataatgaaaggtcaggacccaagtttacttgaaaggtatctgcaaagggaattaaatactgagagggccagtagcacattccttatgtgaacagtaatggcttaggtgtcaggtacaattgagctttagtgagagtgaggttttcttgccctggatgtcagtttgcctcctggtctgtgaatatggtatataccaggagtctatgccttcatggttccatcagtctctagggtcctttatttgtcctctaggaagttctaaggagctatcatggaaagtgaatcatggtgagggtgatcaactccttctaattcttagccttgaattatagatgcccaattactgatgattaattgggaatataaatattgttcatcctttccacttctaactcctgctggcctttgctaggtccatactgtaatttatgatactctccattgtctaaggataaaattcaagctccttagtgtataaagacttcccttatcaagcccttgttcttcttttgagacatcttcattgctgcctgtgatacctgctagctgccagccatgccagctattgatatttgaggggctccaaggatcctgggctgtctcacatcatgcttttgaatatgttctaccttagccaaagttggcctcccccattttgtctatctgggtaaatccttctgcgatcatcctctaataggtaaaggttcctcctctaggatttttttcttgactctcacaaccaaggatttttgagttcttctttattaatgtcctacggctgcctcaggacatgttctgtgagttacagatatttatttcattcttgactctgaggtctttagtgtcaggaactgtgacttcaacctccttaccaccacttcttagtctggctcctggcccatgacagatagtcagtaaatgtgaaattccggaggaaggagacggtggagggggaaattcatctccattcgtcttttaaaaaaaaaaatctacatcttgctaagggaattcaaggtcattctcttgcccacccttagctaaaatgcacagtaagctggattcttgctcaaaggaagccttgtaatggagaatattttggataccaagattagttttatgagacaaggtttatgattaaagttgagactaaatttctcatatttaatcatggaatctttgagaaagatactagtaagaagtaatatagcataggcatcaagaacaccaatcatggagacagactgccctggttcaaatcccagctctgccatttacaagctttattaatttggcaagctgtttaatagctcagcttctccagctataaaatgggggatagtaatagtacttcttaggggttgtgaggatgatttcatatatgtaaagtgcttatacaggactctggaatatgataagcactatatgagtcttcattctcactcattgtctagatcaggattttcctaaatatttagctgcagagtcttttgtttgacacaaccttccacagaagttcacatataaaacataaatgcagatctgtcttatcgaaatggggtatagggctgggattaagcccagagctcctccctgaccatgcctgaggggttctttggagcacttaagactacagaagcctggttgagaagctctgatcacatcacaaagcccacattttctagaaggactaagatcacctgatcctcaatcccctcaatccagagcaagctccttcgaagacccatctcttctacccccgttccctgcaaagaacacacagaccggacagaaggaaatgggttctgctcctcttctgcagtcattttttatctgacttttaagttcaggggtacatgtgtaggatgtgcaggtttattacataggttaatgtgtgccatggtgattttctgcacagatcatcccatcacccaggtattaagcccagcatccattagctattcttcctgatgttctcgttccttctacctcccaccctttgacataccccagtgtgtgttgtttcccccatgtgtccatattgtctcatcattcagctcccacttataagtgtgaacacatggtatttggttttctgttcctgcattagtttgctaaggataatggcctctagctccatccatgtccctacaaaggacatgatctcattcctttttatggctgcatagtatgccatggtgtatatgtaccacattttctctatcctgtctatcactgatgggcatttatgttgattccatgtctttgctattgtgaatagtgctgcaatgaacacatgcatgcatgtatttttataatagactgatttatattcctttggatatatacccagtaaggagattgcagggtcaagtggtatttctgcccgtaggtctttgaaaaatcattgcactgtcttccacaatggttgaactaatttacactcccaccaacagtgtaaaagtgttcctttttctgcacaacctcaccaatatctgttgttttttgactttttagtaaccgccattctgactggtgtgagatggtatctgtattagtccattttaatactgctataaagaattgcctgagactgtataatttataaagtaaggaggttctgttgactcacagttcagcatagttggggaggcttcagaaaacttacaatcatggcagaaggcaaagggaaagcaaggcactttcttcaaaaggcggcaggaaggagaagtgccaagtgaagggtggaagaccgccttataaaaccatcagatctcatgagaactcactcactatcacaaaaacagcatgggggaaaccaccccatgattcaattacctccagatggtctcttccttgacacatgaggattatggagattatgggaattacaattcaagaagagatttgggtggggacacaaagcctaaccatatcagtatctgattgcggttttgatttgcattactctaatgatcagtgatgtcgaactttttatcatatatttgttggccacatgtatgtcttcttttcagaaatgcctattcatgtcctttccccactttttaatggagttgtttttttcttgtaaatttgtttaagctcctaatagatgctggatattagacctttgtcagatgcatagtttgcaaaaatttcctcccaatctgtaggttgtctgtttactctgttgatagtttgttttgctgtgcagaagctcattagtttcttaattacatcccataatgtaactagatcctgtttgtcaatttttgcttttgttgcaattgcttttggtgtctttgtcatgaaatctttgcccatgcctatatcctgaatgacattgcttaggttttcttctagggttttttatacttttgggttttacatttaagactttaatctatcttaagttggttttgcatatggtgtaaggaagggatccagtttcaattttctgcatatggctagctagttctccctgcaccatttattaaacagggaatccttttcccattgtttattttggtcagatttgtcaaagatcagattgttcataggtatgcagtcttatttctgggctctgtattctgtattctgttccattggtctatgcatctgttcttgtaccagtaccatgctgctttggttactgtagccctataatgtagttggaagtcaggtaacatgatgcctccagccttgttcctttttctgcggtcatttttcagtgccccctcaaaaagcttgcttaatgatatggctgcacctcattgttttctgcctggtggaagtgtacttctgcagactccaagatttacatcttagagtctgaagaaagaaggacaagaaatgaagatgtgatttttactgtgcaacttgccttgttctgtttggtaaaattagaactggggttcactctcttttgccaaatattttaagaattgccccaattttaattcattactagccatattttttactcctaatttgctctcatttgagcacttacattgtccccagtaggctatggccatactttccacgtctacactgtaattaaatcagaatttttgtattattatataaatagacacactggtaaaccaacctagcctttgttatagttaccattgcttacttggttgactcagcatacatactcagagcgggttattatcctcactcaactcaacagctcctgtactagtaactaaaactcactctgatggagaaaataatatatctttgttttctagagcacaacccttctgaccagctacacactgtagagctgtgtagactattttgtcaagagacaagaaagttgttatctttgtatataatcatcgcagtgatagaagaggcacttccagcttccttgttacatgcaaaagcatgtggattagtccccaaaaatctgtctttcccattattagtttgctagactctgaccaaaagagaggccttgaaacaacacatgtctgtgtgtgcatatgcatgcacacacacactcgcacatacacacacacatatttacattccttgtaatatgcgcttttcattactcttaggtgattctacaggttacatgtttcatttgtggattgtttttatcaggttgccagagatagcatggacctgtttagttattctttcaacaaacatttattgagtacttagtggtgatgaatactgtcttcagactctattttacattcacaaccatcatataaattaagcactgtcatcctcattttataggtgagagaacttagagagctaaagtaatttgcacaagccaagcagccaggttttttttggcggggtgacaggagtggggaagggggaggaggagaagtagagagctgggatttgaagccaagtattatgtgagagttcaaaccagcactctcaaccaccatgtgaagtgcctctacctgatgggatttacatggaaagatgaagattaagaacactaagttatagaccctggctttgggaccctcaaacacaccaatacaaaaatctgatgaggagtgataggtgctacgtagaacattcaagcatagggccctgggacagggaagaattgagtctggctggagagaacagagcagagggagagatcaaggagagttttgcagaggaagtcctttcatcttgtccttgaatggtaggcaaggattctattattattattactattattattattattatttagagatagggtttccctatgttgcccaggctgttcttggactcctgggctccagcagtcctatctcctcagcttcccgagcagctggaattataagcaggagggaaaaacttattgagaaggagaaaaataatctttgtaagaaacagcatgaacaattgtatggctatatgttgtgtccagagagtagtgattaggctgatgtggctagagtagagtgtgaaaatgggagaactggcaaaaactgagactgtaaatgggtctttattttgagctgtatcagccagggctccttgcatgtatgcaaaagaaacagactctaggttgagctaaagtaaactcacaggaggtatactgggagcttacaaagtcagctggagagctggcctttgagactggcaggaattgcttggagaacagcacctccagagaggcaggaaagaggaatatcaggaatggtccccagcaggaagagtctggtcaggataggagcgctccaacctttgtttctgtcccctatcatgtgttggagatccagagtctaggaggatgacacccagctggctgagcttaggtcccctatccttccaggccttagggaataaggctgggaaaggcatccagtggttttttcagcgttttacatgaaaaggaagagtaatttaccagaagtgaaggaaagggactctgctaggcagggagaatgggtgcagggtggatttttaaaaaattcgtctttagaaactatctacactttcagaactgggtacccacctggtcagatccatgagctggctgcccatgacaacatggagggaggtttgcagacatttgtgggagaggcagtggccttgctaagaggctactgctttggtccaggtgagaactgctaagtcttcagagtgaatgtggggatggaggtgaggagacaggctcacagggtggtaagaacagcactccattgctgcagttaactataatatcccttgcttagacagtgttacattcatttgatgagaatattattgatctaatgaaggattatcccaaggcttatgattttataaatgagaaaataacacacactccagggagacttagctgttacattaacaattaataggaaaatctgacaaagccaagacttggaagtcatgcttatcatgaataatatagagctgagggagttggttggaacccaaatacattcagagtaattttccataaacctgccacctctagtttgaaaatatttcatgtgtgagactgcgattctctctgacaggctggggtagaaagaagaggatgttggaaaagtaaattgctctttttgtaatggtaaaaatgtcattactgggaggaacataaatctttctgatcaggtgttctatcttcagctgagattctggttctgaaatctttggcgttataagcaagcatatttgagaacccctaaatatatgataaccagttttattttattatccaaacagtaataggagtatttttttcaagttattcagtggagccaatcacttttctcaaccctggaaacagcagtaatttcaaggtgaagtcattgtggtaaaactctggcctccatcccagccagccctgatggttccagtgaacttattccctttttttttgagacggagtcttgctctgtcaccaggctggagtacagtggtgccatctcggcttactgcaacctctgcctccggggttcaagcgattctcctgcctcagtctcccaagtagctgggactacaggcacacaccaccatgcccagctaatttttctatttttagtagagacagggtttcaccatgttggccaggatggtcttgatctcttgacctcgtgatctgcccgcctcggcctcccaaagtgctggaattataggcatgagccatcgcacccagcctacagtgaacttattctaacaacactgatgcctttttttggattctctgtatgagttccactttgaagaatctgcttgagaggatgaggccagtttctgtatctatgaattaggttcaccagtttccatagtgtaattccagacaccagttaggaaaggtttgcttctgactaccagaagactgtagggaaagagtagaactggtcttagtttgtgtcccctaactaactgcagaccctgagacaagaatctgagagcaactagtgtatttagggagcactgagagggggtggtgaagcgagatgggaagagagaaaaggcaatgaagtgtacatcactgagcagcacagctgtgagcaaggggagcgcaatcccatggaggaccctcagggagactgtgtgggacatacttcagaattgtcccactgagaggagaggaagcatttaaccaccaacttctcatctgaaggtcacttcaagggtggggctacatctccagtactcccagcctactctccacccaaacacatgcgaggcatggacctgcagttagagaatgcccccaagaagccatttgtatacacaagaaccatctgcaggcaacctccaggattgtccctggagaaatggcagcacacaatcagcagctgatacaaaatgaatgggaaaaaattaattgctgcaccttaaaaaaaaagtcacaagtatcttaaagaacttgccatgatgttaaaagtggttaattgaatttctctgagggacccattcagaggagatattcagccatggatcatactctgaaagaacttataatctaataacagagttaagattcatttacaaataagtctaatacaagagacaaagtgatgagagatgtagcaaatcatatgcagaatgagaggtggcagggacaacttctagataggaaggactccagaacgatttctcagagaaggcagtacttggctttcacactcagaaatgaagagggtggaccttcgatgtgatgaagcagaatcattacagacacagaggatgggaagcaaaggacaaggtttgggtcaatttaacctgatgttgagggagtgaaggtgagctgggggaacattagaaaattcaattgacctaggcgttaccattcaggacataggcatgggcaaggacttcatgtctaaaacaccaaaagcaatggcaacaaaagccaaaattgacaaatgggatctaattaaactaaagagcttctgcacagcaaaaggaactaccatcagagtgaacaggcaacctacaaaatgggagaaagttttcgcaacctactcatctgacaaagggctaatatccagaatctacaatgaactcaaacaaatttacaagaaaaaaacaaacaaccccaacaataagtgggcaaaggatatgaacagacacttctcaaaagaagacatttaggcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaattatgctgctataaagacacatgtacacgtatgtttattgcagcactattcacaatagcaaagacttggaaccaacccaaatgtccaaccatgatagactggattaagaaaatgtggcacatatataccatgtaacagtatgcagccataaaaaatgatgagttcatgtctttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtggggggaggggggaaggatagcattaggagatatacctaatgctaaatgatgagttaatgggtgcagcacaccagcatggcacatgtatacgtatgtaactaacctgcacattgtgcacatgtaccctaaaacttaaagtataataataataataataataaaaagaaaattcagttgagcccaaattgtgaaaagtcttcaataccaggctcaggatgtcaacttttaccctttaggccggtggtttgcaatggtgtaccaggtatatggggtgctaccaactctttcaggtgtaatataactttttttattttctgcaacagagacacacatacatgcaaacacacacacacacatatgcccactaatattgttataatggtatctctcaggcaataaacatctattactgggtcatatgtcatagtgtgcaacaggatataacttgcaagaaacaaatagaaagaggtgggagagaataatgagatgatgtttacaacaatacaatattgttgcaatacagcaatacaatattgttgcaatacagcaatacaatattgttgcaatacagcaatacagtattgttgcaatacagcaatacagtattgttgcattacagcaatacagtattgttgcattacagcaatacaatattgttgcattacagcaatacaatattgttgcattacagcaatacaatattgttgtaatacaatacaataaggcaataccatattgccttgtgtgtatataaacaggcacaggcagggcaacaaggagatctcaaacatacctcaaatgcaaaacgcaaccaatagttcagtgattaggggtcaaatcctctcaatactgtcaactgggaacctgccccaaaccaattttaatatttagaagtgtgccaagaaaccaaaagggttgttaacttaaagcaatggagaaccatctcaaggtttttttggagaaaagtaaggtgacctgttattaagagcatgagcagtgacatgggttctccatggttctctatagatgaggggctttctgtaataaaaatatgtgttcaggccacttgcaatacaacttatacatgtggcaaaatgggaaactgaatggaatattttgggactagagacaactctttctgatatgagtgtaaaaggaaaaacctagcctcccacatcaacttttatcagtatgcatttgacaattatgtactgactccaactaaacacaagagaccttttaaatgccgggtcagaaagacacttactggtatgtgaccttagtaagttactcatcctagtgtcagtgtgctcattggtaaaatggaggtaaaaagatcaaccttgcaaaataattgcaatgattaaataatataacttattaaaatcttggctcttgatagcaggattcaggctacagaaggagtcagactaaataatttggccaatagatcagaatcatgatccaaaaggccttcaggagccagtaaaaatttgaggtggctaagagtaggaaatagagtgatggacactgtggggaactagagagtaaaaaggtcttcaaattaaaaaatacacgagagtctgggctttccaaacaaaatatgttgcctggccaagttctgcctgccagatcctagtgttcagccactgttctagatcattatctgggctcccattgccgtgccatatgattgacaggtattaccaatcaaacaaatcacttttttactgagcttagatgagccctgagaattcttctcattatgatacattgtgagatttagtttactgattcttctcccaccctgcttcccaggctcaatatgatggttacaacaagttcactttgaacatattttcaaaaatactttaacatatgagtgaagggggtagtatttcttgtataaatgtgcagtttcccagtaccttcttctcctaactcccaactgtccacaattaatttttttccttttgcattcattttaaaatatatatcaagtctgcactactcaggcattagggctataaggttacccgtcccttaagggatgcagagtctcatagtgtgctatggaacaaggagcctagggatcctggcaagagtagacagggaaataggcttatttaggaagttgagaaaacaatgcctggctccagtgttggctggcacaaataacttcaccactctgagtctgtttccttagcttccagtcaggataataatctcttccttgaccacctgatgatgtaactgtgaggatcaaataagttcatgagtgcgtaagagtttggcaaactaaaagccttttaacattgttgttcttcacgcctgtgatcccagcactttgggaggctgaggcgggtggatcatgaggtcaaaaatcgagaccatcctggctaacatagtgaaaccctgtctctactaaaaatacaaaaattagccaggtgtggtggtgcacgcctgtaatcccagctactcaggaggctgaggcaggagaattgcttgaacccgggaggtggacgttgcaatcagctgagattacaccactgcactccagaatggcggcagagtgagactctgtctcaaagaaagaaaaaaaagtattgttctgttgtaagggaattgtggggagtgggttggtagagtatgtctgatgaggctgctgggctgctgtgtactgattaagttgtataattttaagatttgccataaaatatgtgttaagagtgtccaggaaaccaagagaactttctttgcaaggatccatgtttggtgataataatctcaaagaacagaagtaaaataaacgaaactatcattttgtagattgtgtcatccctgtgctacaaacaatggaactttctgctgtctaccatctatcatcttaacttaccctaacacactcatgaactcatgtggtgctcacaacagcatcgtgaggtagtccaggagtggatggatgcccttgggaagttactcatgtccagccagcatgacagccaggaattgaatatgggttttctgactttttatataacactgtcaactttcatgtctactcctacataaaaatattgttcaactaagctttctagaggaagatgggaagaggaaataaaaaagaagttaaaacactgctattcccgtccatgtctttagctggataccagagatggcactgctaggctttggctgcccttggcttgcataatcatgccctgattgaatcattgtgctggcatggccttacctgcagctaacctgatgtccttctgccttgctcaaatgctagaaggcatagatttacacttaaatcaatatttaatctaatgtacctctcttgactccatttgtaaaatggtgtgtagatcttggataagaacacaagcctacaagctgaatcaaagccatttgcaaggcagcaaaatcaagaaggagacatggcaataaatgcagaagagggaaggtctccttgacaaggaatagcgtattttcttgccctcctccttttttattaaagcactattaaagacaatagtgatttaacatgccttgttgcaagtgaggctcaggattccaataggcccaaagacattaacaataatgaagaaaaataccctaacaaaatagttggaattcttttcagtcatacatcataatacttcagaggatattttcattatatggataagaaaaggccttatatatgccttttttcatatcataaaataataaacacagggatactgaatgcaacttaaacctaaatatttcattattatgtagaaactgaaatctatggtcactattcaaagtgcccctgactcaaaatgatttgcccgaattccatttagattaatttcaaactagaaatggaaatcttagcttgatcttctttaaacaggttgaacttcaatttccaagtctggaaaataaattgttgtctgtggaagggaaatgataaattaagtgagcttgaagcatgaaggaagaaagaaagaagggaagaaaaagagaagaaaaagggaagaaagagaagagaaagaaaaggaaagaaaaagagagagaagagagggaagagaagaggaaggaaagagaggggagagaaggagaggggagaaatcacttccagtgagctggaagaatcagtttctcaatagtaaactgtacatctttcttattggcaaaatcagacttatctctatcaaagagagttcaagtcttcaagttcaacgaattggtctacttaatttagaagtgttttcactcttcctatgctaaaatattgtctcatattcaataatgttctacatgaccatgtttttggtggacagtaaaatcacagaaagggattcattccataaatttacaattaagtgatgctatgaggcatataaaatgaacagcatttcatccgtaagttctattgcctgcttataagtgtcaacaaaatgcccctaactccagaatgcctttggaattgcgtgttacattgatagaagactttagctacatgcttctaaatccgtagtttcaataagcaatggctccactcataagcagtgcctttaatgtcacttgtggtaactaaggcttttggaagtcaagtcagattcaagacaaggaacacatttgataacacatctaatacaaagcataaacgttgaatttatatagtggtgaaacagcctctcataatttctttcagccctgcccccaaagcttcttcaaatacacatataatcagagcaggagcgtggcacttgctgtgcaagtacaccttcaagccaagtgcctttctcctcttcaattccatagcctcccccaaacccatcctataggaaaattttgaagcctttacatgaacaaaattatgacatttgaaaatgttcaaaatacctaactttccacatttagtattctttttttttttttttttttgagacagagtctcgctctgtcgcccaggctggagtgcagtggtgagatctcggctcactgcaagctccacctcctgggttcacaccattctcctgcctcagcctcctgagtagctgggactacaggcacccaccaccacgcccagctaattttttgtatttttagtagagacagggtttcactgtgttagccaggatggtcttgatctcctgacctcgtgatccgcctgcctcggcctccgaagtactgggattacaggcttgagccactgcgcccggcccacatttagtattcttgtaatgactatgagatttaaaaccatcctactaattcactgtaataagctaagattttgtcacaagcatagttaggaacaccattctctatctgaagggcacatgttaaagtacacgtgggtggttatttgtttttatgttaatgtttacacaaccctcttaactctgatgacacatgtctttctatgccagtgggcaagagtgttagacaaagacactgttttcaaaataaaagggagagcttatggataaaccacttgagaatcacaaccattcatctatttctttttaacagcacacatttccactgtgaatgtctgatattgacatttactttgtcattttaggtttaactaaacagtcaattagaaaaacatgaactatgctttaactgatctttggtgtaaattagattataccatttctgttggattcatctgaaaaaaataaatcaatactttaaaatccatgtccaagaatctctagttggcatctgaatttgtcaacaattgttcaattgcttagtcaatacatgtttattcactgaataatctgcctggtgctagggagatgctaagataaatataactgtctctgcccttaggttataatctagaaggaaaaataatgcacgtagagactcattctgctttatataaagcagaatgttctaggaggaagacataaagtgctgtgagagctgaggagaaaggtttgattggagcctgtagagagacagagatcaggcaagccacaaagagcagctgggattagggtccatactgaaaagaggggtagatttttaccctcaaataaatatactctttccttttccagaaaggggagtccagcttttctaatcttaatatgaagatgatgacacaaagatgtgtttgagaaagtgaatcatatgggccaagtggtctgcgttgtgtgtaattatttcacctacatgcccctaatttcacttagctgtaacaataaaaagccaaaaaaggtctcaaaacatttcttctttttttttttttttttaagttctgggatacatgtgcagaacatgcaggtttgttaaataggtatacatgtgccatggtgctttgctgtacctctcaacccatcatctaggttttaagccccacatgaattaggtatttgtcttaatgctatctctccccttgtccccccatcccccaatagaacccagtgtgtgatgttcccctccctgtgtccatgtgttcccattgttcaactcccacttataagtgagaacatgcagtgtttggttttctgttcctgtgttagtttgctgagaatgatggcttccagcttcgtccctgtccctgcaaaggacatgaactcattcttttttatggctgcataatattccatggtgtatatgtgccatattttctttatccagcctatcattgatgggtatttggattggttccaagtctttgctattgtaaatagtgctgcaataaatatacgtgtgcatgtgtctttatagtagaatggtttataatcctttgagtatatatccagtaacgggattgctaggtcaaatggtatttctggttctagatccttgaggaattgccacactgtcttccacaatggttgaactaatttacactcccaccaacagtataaaagtgtttctatttctccacaacctcaccagcagttgttgtttcctgtctgaaaacatttcttttataacagatcttctccacagccaatgcaagagagaattttttaaatgcaaaaagaaagttaataaaatatcagatggcaataaattgctagaatttggctcagcctagaaaaccaaatttgtctttgactttgcaaaccatgccacatggagctggcttctgaataaaattgggcttctaaaaaaaactggggagaaaaagtacaacaattacaactgaatcccaacagtgtcaggatccaccagtcagtagctgctctcatcttttgctactcactccagttagggtttcccaaccaattgtagctgcaggtacaacggcagccacagctggagactgcacgggacaagaaaagtagcaccctcatggccctggagtgtaggcgttgctttttagcccactgtgtgaccctggataagtcatgtctcatctcagttttctcatctgaaaactgccatgcctgcatcacaggcttgttgtgatttttccagggagataagccatatgagaatgctctgtaaactgcaaagcgctgcctaaagctcagggagtgtctgtgttaaaaaccatcaccatcggcagttggtttctgtcctgaacaagaaacctcccttactgaggcaaagtgctttaatttttgtaatccaggcctttcttattgctgctttcacttagctgtgtggcctcagataagccactgaaactttttaagcctcatttttctcaaattcaaagtggacactgtaattatgtctgtactgcctatctttgaggttcaccatcataatcaagtaagataaagggatgtaaaagcaaattacaaatataaagcaccccataaatattaatgttatgctcatatggaggttccacctggatttctgacccagacttcttgattgagtgcctgaccctttcctttaaaccacccacctacatgtagcttgtcaagtgctgctatctttaagctttcaagccttctgctcatccttcaagtcctgcttgcctctctgattctagcccactgaacgctaatacagcacatgctcctactctgcagtggcccactctaccctgaccatcattttagaaatcatattccagcaccaagctccttctactccaccatcctgtgtctaagcccaagctaggccatgaattttcagaacttgacaattccaggtctttatctgcagcctgcaactctctgttgcttagactctcaaaattcacagctgattttgtttcatttcattcctggaagattcaagtagggcagtgattctcagcattgtctggacattggaatcacaaggggaacctgaaaagaataacaatgcctgggtactatcccccgaagattctgatacaatgggtctggagggtagtgtgagcattaggatttttcaaaactactcctatgatttaaatacatagctaagtttgagaaccgctgacttagggggctgttcccagccaagttgtaacctgggatgggggtgggggctggtgacaacccacctctcacctgcattgggtgtggtggccagaatctacaacaaaggcaagtcctgaaaccaaatcctagggaaactgattaaaaatagcagcctagtccaattgggttaccaggtctcaggtagcagaactcagtaaaaagagaaataggtatgacaagaccagatcttggtgtccccagtcaagcattgtttagattctatccctgggtttgggaagggggcatggtcaaagaaaatgaacatgattttccctatagcaaacaataatagaatttccatggtctcagaagacagcctttattctgatttgttcacatctacaaatttataccaactctgggtcctggaagtcttgttctttcccacatatgaagtctgataaaaaaccagaggtgaaggtggcaggagcctcaatgacttgtccaaggtcacacagcaatctgaaggtaggcttaagagcagaggacaggtcttttgtcaccatccaacaatggacctataggaaattgatttgtatatcgtgtatttaagccatgaagtcaagaactatgtggaatactcttttaaaatagatcactatttagaaaatttgtgactcacaaaaatgttttttaaaactctttttccattttgaaactgtagagcaagatactttgttaaggacggaaccccagcagatgagacccaggtatttgccacttactgtaaaggaaaaaagagagagaaaatgaatctggatattttactggatttttcccagctaccaggagataattaagattctctaatatatttgctctgtaatttcttggggagggcaatcacctagctgggatgcattttttacctagagccagggtatttattcctctaaggactcacaatatagtcagatgccaagaacatgtgaataatatttccatacaggtgaatgttaggccagaagtgaggcactagaagactcatatccctggaggacttcagctaactggggcaaagtctgatggaatctacctatagacccagatggccagagaagacaagcaaggcaataacaataatatgcagcattgcactttacagtttacaaaacactttaaggcattgtagtagccatgtctcagaaaagtatacaagtcaagcaagtgtcacaaaataagttgaaacaacttaagctattttaagaagctggggagaaaaatcactgtgggaatgccccatgatttgaagaaacctatttcacaggtggcacaagtaagttcagcaagattatgtaacttgtcaagctgacatgaaaataatgataggcccaatcctaatgatcaaggttcttatttcacattcagagtctattttactatcacaccacagatgcctcaagtaaaagaaatgcaggcagggttgagaggccaggatgccagagtcaggaagaacagcacaaagaagaaggtttggtgagcccagttctaggactgggtgtgagacatcctgggctggtgagtagtaagtaggtggttggacttagggcagaggcctggggctgctgtcagccttaatgaaggaagagatgccaccgtaattaatgagtgtttctggaatgtctgtatgcccaggttgtatctgcactgaagatcatctgagccggctgagcagtattaagtctgtctctgaaatgaccactcagatatcgcctcaacctaataaaataacttaatggaatttttcactctgatcagatggtttcaggcccagtttaggatgactgatcacattccctgagccgctctgtcatcctcccttcgctggagcttgctgggttggctagtgataggatttgagtgatgttgccttatggtttatgtctctgtttaactcgaatgaatattatggaacttaagtaaattgtttaaaataaagaataaaagcatttctgtgtcttttctctatgttgagggaatgatggaatagtggacttcattttagagaaaatcagatatatcgatcttttcatctatgtggatactgagagctttcatactttggtttggaaagacgaacaaaattcatacccaactaaatgccttatgtatgcccagaaaattttcctccatgaaaaagagatcttacaagaaatctgtacctcactttctctatcctgtgaaagttagagatcttttctcacattttaaatgatacatgatacatgtatgcctatgtataaatgctgctctagatcatttgggggacagaaggaagagggcggaagagcacttggaagtatagagaagttgttaatagatgttcatgatgagagattagagtttaacacggtaacaggcttccacttcgtaaaataattggttaagatcttgatggggatttttcttcccaaacctcttggtcaccctgacctgactttagaagtatcaaagagtgagaaagtcacatgtagtcacatacacacatcataaataagtgtgtatcctcataaaaatatgcagaaaattttaaagatcatgatttttaataaaggattttatagaagcacacaatatcaggaagggttgttaaaaacataacattgtgttcacatggtgtgtatttatcaaattaagtttatctaattagcgtggcaaaataaaacccttactataattataatttggaatttttgtactataagaatttttttctcaaattacaaaagcttgcatatgccatttgtctctgtaaaaattaaatatattcatttatacgtggtattttaaaaatgagagatagtgagaaattctggatgtgtttactgatgaccatgcctataattagctccaacttcctcatttaaaaaggagatttccaagaataatagctcatctaattgaagatcattataaacaaattaggatgtaattgtgagttgtgctaatgatgcatgttaaatgtataaagtgatatcctggtgtagaattatggtgaatatgtttgtccttaccattctttgtaattatcatttctgttatgcttgtgctgtttctgttttttttttttatgtgtataacattttggaagtagggaagttgcaaaattggtgctgtgctttgggacaattcatttactgagcaggtatgagttggattggaggagcaagagaagtccttgatgaagggaagggaggaagctataaagagaatgtttagttttattaatatctgatttaaaatatcatgtattagatgttgattcaacagagttatatcattcaggaaaatatgacatatcaaagagaaatatatacagtagtcttcccttatcctcagaggatatgttccaagacccccagtggctgactgaagctgtgaatagtactgaaccccgtatatactatgttatttcatatacatacattcctatgataaagttgaatttagaaattaggcacagtaagagattaacaataaaatagaataattataacaatatatgtaataaaaattatgtaaatgtgccccccaaaatatcttacccttctctactcatgcagttttgggctttagttgactgcaggtaactggaattatggaaggcaaaaccacagataaaggagcactactgtatttttaaagaatgttggcaaaaatatattaaacctcaaaactggcttagcaattaataaaacttttgagaatgtcttctgtgcaaggaattttaagcattttatcatgcacatacttgcaaagtgatgcagagctctgaggaaataatccaaaagaaactttaaacataattgtaatatgaaatcaccatgagttatcttcatgcaaatgtgtctgggtgactcatggcactgatccaatgacaacccttctgtcctccccagtagttgtcctttctcaggaacaggtgaccacgcctgcctaaccacatacatccctctcctgagaaaagtccactctccaggacctcactctagctgctgagggcactccctggaggatgtgtttaactacatctcccaaaagacaaactgcaagcccaggagggcgatctcagcaggcaaagtattcaggacacaagagtggcctctgagcttcttttcttctttggctcctggaaactaagaacaagggaagaagtggactcagcatgggcaatttttaaaagttacacagttagttcagcctcacaacagatgaactgacttttcttttttttttttttaaaggagttaatggtttgggctggttgtaatagctccttgtaatagatagtaaagagttttctggattgaagccaaacttaccttcagtgaaaaacacatgaaggtaattgcttagagaacttgcacactgaagagaagaacagttcatgacattttaacacaataaatgatggggaaatcccattagggaattaatcttttatccatggagctagaaagttaaaagagagaaaactaaaagtattcttttatctgctttaaagtgaaaaaacaaaatcctaagggagctacatatttgctagaaagtacagggactttcctgagcttgtgctctgatgaaataaggggttttattcttaatgcagtttaacatgcatcttcatgtggacttgttttcactgaatacctttatgctatttctgtaagtatattattcttcattgttctaaactttggcatcaaaaattacatgtatatttgatgattcaaagaagataattataagtttctcttctctctttttgattatgcaatatataatgagggcacatttactctctctgcatactcggcactcaatcatgtttgctgttcactcacattcttcactttcttagaagtcctcatgctccgactgctgctatcccaggtatggtctcctgggccccatggtggttttataatgctgggatcaaagctcagagatttaactgcagccattttaaggttatggcccagaaaatactaatcaaaaaatttaataaaatgaagattgaggggagccttgcttttccaggcttcttgctcatactgctaatcagcctttattcatttgacaaatatcactgagcacctactaggtgcccaaatctaaggggctggagatatagaaatgtccttgcctgaaaaagtctacacataactatagtagatcagcatctgaacaagttattatagtaccctgtgaaaaatgctatataacaaaaaaaaatgtgatgcggctgtatcagacagaaatatttcaatgcaaagacacaaagtaagactaaaactcagggtagcccaaacaaaaaagctaatttattagcttgtacaactaaaacagaattattgctgatcctaggcacctccagtacctacaatgtaattgtatttagagatagatctttgaaaatgttattgagttaaaatggggtcattagggtgagacctaatccaatatgactgtgtccttataagaggaggagatttagacacaggcatacacagaaggaagtccacatgaagacacagggagaaaaggaacatccagaagccaaggagagaggcctcagaagaaaccaatcctgccaacaccttgatctcatacttctggcctccagaattatgataaaatgaatgtctccttgtttaactcagtctgtagtcctgtgttatggcagccctagcaaactaatactgggcactgtcacaggctccatggcggcttctcatcaactcttaccatcaccctttgggctacaaaatagcatcagctgttccacactttacgatttctcactatattatccaagtgcagcaagaggaagcttctagtagctctccatgttttagaattcccactctttaccatgcctttgtctgaacagttgctgtggcttagggaatgcaatttgtggactggctgaagctatccaggacacacccctgagggtgggtgaggtcagttccatccaaaccgaataaggtgaggtccccaaaggaaggtcaaggaatagttgtagagcatagcatggagataaccaacaaagacccacagaaagtgatcaaataaatctacctggaaaagctgagcaaaagtaaccctgaggggaattaaggtgggtcttggagaataagtaggtgttctgtagagaaggactcaaagaataatacacacaaaggaagcagcatatatgagggcacagaaggcacaaaagagtctgttgtatctggtaaggtaatcaacatgtccctgtctacctggaaatttccagttttagccctggaagtcctacatcctgagaacaactcttcttgtttctggcagatatagtttgcctggaactgtatctattttaaacggaagttccacatcccaagacccccttagtcttggacaaacttgggtggttggtcactctatgttgggggaattatgagcaaggtttatgaagcaaattggctggagataaaataggaaagactggctgaaactaattgcaaaggacttttcatgcaccctagtttgaagtagagaaaaaaatctgtagtgttcctttgccatattgcaaagtaagttagtaggatgttattctatggagggtagaggaacttcgtgttaatcatacaaatgccatggacctttcacaacttgacctgtttcaggaagttcgtggaacttgagggctatgtagcattgggagcagcagaaagttccaggccaacacttctgactcagagacactgatctctggggtcaagggtcagcactctgctgggcacatcacaatgcccccaaaatactagttgattcttggttaacaagcttcccttagtaagtggaatggcctcttcatcttcaactatcctctctgcataccttcctctaaaagttgtatctcttttttctaccttttcatgccttcatttccaattgccaaccaggggcttcaaacccaccatacctaccacttaactgctcaccttcccccaacattacctcttccacctactgctttctgtctgttgaggacgctgccattctccagccacccaccctcatgctgtggaatacactgcagccactgaaaacaagtggctgaagaaaacaaagttgcaaacaatggatatttagaatgatctcatattcatatagattacatataagtactttcagatatatataaacacaaatatacaggaaaaattatccggaagtatatataccagactcttttttttttcttttttttgagacagagtctcactctgtcgcccaggctggagtgcagtggtgcaatcttggctcactgcaacctccgcctccctggttcaagcagttctcggtataccaaacccttaacagttactattttgagagtgtctgatgggaaacggaaggggggtccttttactttttgctttatatacatctctgtttaaatttttaaagaataagcatatgtaactattttccaagcaaagataatacacgttcattgtggaaaaattaaattgatagtagatgatcattacagaaaacttaaattgcagataaacataaagagcaatataaaaccatctgaaggctgggcatgatggctcatgcctgtaatcctagcactttgaaaggccgaggtgggcggatcacctgagatcaggggttcgagtctggcctggacaacatggtgaaaccccatctctactaaaaatacaaaaattatttgggcatagtggtgcgcacctgtaatcctagctacttgggaggctgaggcaggaaaatcacttgaatccaggaggcgaggttgcagtgagctgagatcgcaccatcacactccagcctgtgcaacagagcaagactccatctcaaaaaaataaaaaataaaaaataataaaaataaaaccatctgaaatgtcaccaccagaggtaccattgttagcagtgtggggaacggcctgccagtcctctctctgggcaccattgctgatggagatacaaagattgaccgaagagatctccccaacctgccctgcgtcctcctcactgactgtgacccttagcaagttgcaaagccctcccatttgctttggcatttgcaggacctctggtatctctcagtctattttcattaccatcactcttgtcaagtctctcattatttctctcctgctctttggcagtcgcctcctacctggctctgacttttctctctccctccttgcaaccaatcacctcacagcctccagattaatcatcctaaagtctagctctgatcatgttatttccttgttcagaaaccttcagtggctccccattgcctataaaaagtgccaaactccatgatctgaactaaaactaaacttttcattgttccctcgggaacttttcttcccctcagttcttgttcatattattttctccaagagaaacaccattttatccaagcatttccatctattaaaattcctcttttttagataatttaacaggtatgagaagacatttgcacaagaatgaaatgttcattacagtcaagtctatgataggggaaaattaaagccaacttaaatgtttaccagaaagcaactaattaggtaagtatggtacatgcagttgttcaatggaatacagttcagctgttaaaatgacatatatgtgtacatatatatacattgtatttattatatagacacggaaagtctatagaatattgtcaatcaatattatatagacatggggaaagtctgtagaatattgtcaatctctatatatagtatatacatactatatatacagtatatagttcatagcatatatatacacattgcatttattatatagacatggggaaaagtctatagaatattgtcaattcaaacagtaggttttgtaatttttttgtaaatatgttttaaaagtgcatgtatttgcagagcttttgggaaagatatcatcaaattataatagaggcaaattttaggtagtagaatttagttgatatttactttgtttttagtattttctatttaatttgaatttatttaaacacagccacaatgatagatgttaccatttattgtgggctacttgccaagtactctgtttgatgttttacctatggtaattcatttagttctgagggtcagggaagtgaagaagtgttcccagggtcataccactagtgagaggcagagatgggattcaaacctgtttttctgattccaaagcacctcttaggcattatgttacataatactgaagtatcatttttccaaaaatacaagctaataaaatatgttctgtcagtcttacacagctgcacttaattgctcttctccccaaaaccttcccttgtccccatatccccaagtatgacaaccatggaagagaacagaatgagatatatatatatatataagatagacacacatagcacaaataaaggttcttaaaatataaacagaattattttacatattacattattctgtgaattggtttacatttaaaatgtacatcctatacgtctttccttttctgtacatattgatcatgctcaatgtatttgacagtttcataataatctattgtatggatgtgctatcatcatttaaccagtcccccatggatgatcatttatgtcatttgtatattttgctattataaacaataccagaatgaacatctttgtctaactctatgtctgttcacatgtgagactgtcttttgcaagatagatttccagaaatagaattactaggtcaaaaaaacataggccttttcctgtatcagaatttctgaaaattttagcagcagtgagagaatatgattcaggaaccagctgcttatattcttttgtggcctcgtttcctactcacagcctcaccagcactggcaactgtctgcacatttgtatccaacatctccaaattgatttgtagaaaaaggtaactggggtatgaattgtgtgagttctggtgagctcttggccaacaagttgctatgcacccttgcacaataaatgatgccacaggtgacatttctttttctgtaaaatcagacttttctagatctggcactaaatgtttcttaactctaaagataaggattacattttggtcctctgacttcttagattttgaaaaatgtatacatactgtaaagggttatcttgcctcattgaaggttcaaatggtatggtgataagaccatattaaaagcatttataaaaggttcatggtaaagagttcattatggttcattaaatcccttcatgcttttatccactttagttactgtatttcctgtaaatgggatttatgccagggccacgttaacaccatttcacattctgctgtgctattacccacggagcttgaatcaattgaatgaaagaggtcttttcaagtgtattgattttcatttatccaaactcatctgtttgctttgccgcatgctcatacatgagaacagggcacagctaatcttctctatggtgttgctttttcctctaagcatttaatactagaatagacatatgacagatattggtataaaaattgcagaatattcactagaactacagttttttatgggtgatataagggtctggatctcgttctcatgtcagaaagaatgtagcctaaagcaagacattatagccttccttcctgcatgaaagcagtcacctcctactcttccagcccccagagagctcagttcagggatgctgtcctcctctccacaagtaaaggagtgttgcctatacagtagttcttctaagaagtgcaaatttttgctcactgtcagggagctaagttttctactgctgctttctacagaaatactccttatttttttggccaggtatcaaactgaaaatctgaacaaaaggaagtatccaatagggaaaataatacttttaatgtgcattgtaatgctcttgttctacattcctagcttaatgtgtatgattgtgtgtgtgtgtgtgtgtgtgtgtttgtgtgcgtgtgtgtgtgtgtggaaattagagagaaagagagagaaagagagaccatttattttaatctacagttagaattttgagatgaaagcgttttaacaatttttattgaattgttgtgttagtcactggataatatgtggctatgtggtggaggattaaatgatatgttctaggcttctagtaaatagatcttgacttctgctcaggtaaatactgaaatatatttacctgggggataaatactgactaaggcaaagcaaaggtcagtatttcctttgagttgcaataaatatttctatacacttaaacattgattttatgttatagctaatgatcaaacattatccaaagccacagcagaaaatattactatcaagctaattctaaggcatctttcttttatgcataatgctacaaaggataatcacttttggcttaattaagatcttggcctaaatgttggctcagcctgagtccttattgtgaaatagaagatgaatagattcatttatgaaaagctcaaagtacataaatataacaaacattaagcattattgacttaaataaaatgaacaattaacaaaagtttgaatacgatcctactgagtgaatgagctaattatttttcctcctacacatttatgtcatgggctatgttacacaatttttgagaaataattcatagaaaggatttttttgaaaaaaaatttctttcaaaggagaactatatcatagtaactataaaacatttgagtatcatttagctagggggtaagaagtatagaaatgtatcttcaagaagattacaatttaattggggagaagagcagatacatgcaaatacagaattgtgtagttgttaaaaacatgagactttgtagtcccagctacctgggactacaggggaggtgggaagatcatgattgtgctactgcactgcagactgggtgacagagacagaccctgtctcaagaaagaaagaaaaaaaagaacatgagatttggaattttaatgagtatgaattctagctctggcactatgacttctgacaatgttttctgagccttggtttccgaatgtgtacaaaggggataatagaattgatttcatagggtaacagtaagaactaaaggtctggaaagccctgaaaaggtacctatcaaaaggagaacactccataagtggtagctgttttgatgatgtattgctaccgtgacagatgaaaattcttttatggaggtaactcaaggaagtacatatgactgcatttggaatgaagcactatttttagcttaattccagagaaaagagctcttacaattgtatttcatggtttgtcaacacttcaaaaaaatggtgtgggatttgaactagaggctgactgaggaatagggttttattagttgtaaaagaggagtgatgagcattacaactgccaataaaagagcagtcatctgttcagcctgggcctgagcgcatcctccttctaaatattctctcctaggttaataccaacattagctccaagttttaaaagtatcttttcaactatttcttctgggtctcctttgtttcttcctgttttgttttagtccccccaaatgaaaaaccactttcaataataaataaacaacattaaaaataaaataagaaaaatgaacataacaaaaaatatcactttcctgttaatataaaacctcctgttaatactttgctgaaggtccttaaaagccgttctgtacctctatctctgtgtgtgtctctctctgcacatacacacacacacttgtctaatctcatttcttccctcaaaaatatgcaatatgccataaatatcttttcacaccaaagaaaaacttcattatatttaaatgagtatatcacatttgattgcatatacatataacaatttaataaactctttagtgggcgttttagttgtttccagtttttttctattaggaaaaaagtgctatagtgctacagtgagcatccttgtacattcattttggcccacttacatgattatggttatccccttaagaaaaataactagaaatagaatagaggaaccaaaagcacatttacaattttggtatttagaaccagaaatgagaagtaaaatcaccacattttaatcttagaagacttaaaaaaaaaaataaaaagaactggccagtcttaactttcatgaataaataaaacagccagtcttttaaaattaatgtttgaaaccaaagcatgaaaaataggagtacataattagaaatagttattttgtgtaattctatataaagcaatgtcttaacaatagaaaaaaagagagaaaaaatgatcaaattgaggtgtttttattgtataaagtcttgccaattaaactaaccaaaccttttaatttaaatgtctaactacacaattaaattaattgattttccagcacaattgtctgacattttgatgagttattatggaatgttgaactaaattgagtgattgtaaatatcttgtagagaggacctgtgaactagtactaatttaatcccttctatgcaattctcctttcctctcatttcttcttagaatatatagagtaatttactttcatttaatcatgggttgtcttgttttcacatttgcatataaagcctccagtcaatgtgacctgattgattgttccaagtgcggcttcttgatttcttgacctgttagtgctagttaattttggaaaatttggtttatttgtcaaagtctatattattttcttgatgtaattctcagatttatcatagtaggctggatttaatgattctgtcctgttgaatatgtgtctgtgtataacagactaatttttgaaccttgtaatttccttaaatcattgtaaaattttagaactagaaaaattatggttcattatttcccaaagtttagccctcaaggtatatatgtccccagataataatgtcgtatgtgttatccaaaaataaatatataagtgagcagacataagtaaatttgggaaatagataaacagcaggtttttctactgaaggactttcacaaacctgtatgtgccaaaatcctatatgacatgcaaccattcacagagtgatttgacctcacaattaatttttataaagtactcattaaaacggtattatttgtgtcactagttagataagcacatatttaatccaatctcctcattttacatatgagtgaacattcagaaagattaaacaatgtcaatattctaaagaaaaataaactattttaaaataaaataataaaataaaattattctaaattggcttcatggtatgttattgcatgttgaatatgaactgccaatcaatagggaaatcacgagtgttttatatatatatataatataatatataatatataatataatatatatatatatatatatattttttttagatggagtctcactctgttgccctggctggagcacagtagtgtgatctcagctcactgcaagctctgcctcccaggttcatgccattctcctgcctcagcctcccaagtagctgggactacaggagcccaccaccacaccaggctaattttttgtatatttagtaaagacggggtttcaccgtgttagcccggatggtctcgctctcctgacctcgtgatctgcttgccttggcctcccaaagtgctgggattacaggcatcagccactgtgcctggccaatcacaagtatttttattaaggaaacagaattatcaacaactgtggtctactcattcacacacaagaccaattttaggactttgcaacccctgggagctaacattattggaaagacatttaatattaagccaaaatgtgaaaatataaagtattacctacataaaacacaaataagaaggtgaaagaggtgaattttaaatcccatgtgtttttaagtaatgatggagtatggcataatagaaaaagtaacctggattggaattctagtgctgacaccgccaagctaaaactagggcttcatcctaatttaagcataattattagctgaattcagagtgaaattgggaaatttcttaaatattctctgagcttccatttcataggagtacaataatactctcctgagaaggtagctgtgagaatataatgagatagttaatatcaaaaaatggatagtactcattcaacaagtattcatttatttcctttcttggggacagaaatgtgcaggagcaggcgggccttggtggaagaccaccatgagcactggggaacagggatattggggagaacggcatctttaaaaagctagaacttttatcaaacaattttctctccctcagaccaatcctgaaaaaaacttctacatgagtccctgatgagttatttcatttattcaaagaactagtgattgttacttttatcataaacagttccagaacaaatcacatgaaaaagctacccagtacaaactatgaagcaaatataactagataacccaaagatgtatcacaaaaagtcaattccccttgttaatataaatgttaaaatgttaaatactagccatgagaattcaacaatgttcattaaataataatgaacataaccaagtatgtttcattctagtaatgcaaagatagttcaatgcaatgaaacatttatatataatacttcaccagcttgttagacatgaaaacccacatgattatcaatagatgtaaaaaatgattttgataaaatttaacaccagtcttcctaaaaacactaaaaataataaaaagatgcttaacttaaatggtgttattacaaactaccagataatattatatttcatcatgaactactggtatcatttttactaaaatcagaaacaaaacaaaaatgatatggtcatcattattgcattgaacataatttccaaagtaatattaaatcaaagacatgaaacataaatagttttatacatggagaagaagagagacgtggcatgactgtatacacagacagtcaaaggtataagaaaaaaaccatctggcataacaaatgattcagacaaatagctgaatgcaagatgaatacacaaaaatctgctatttctgtattctatactgttttagaatatcatttaaaaagattttgttcacattaacaacagagctataatgggcccagtaataatctcacattgaaaatatatgtcctatttgaagaaaactgtacaggcacacacacatatacacacatgataaaataaaagaaccatgaatgatttattttccaggttaagaagactaaaataccaaaccatgtcctttcctttcctctcaaatctgtctgtctgtctacacagaacacagggcacaaatgtctgtagcaacattatttcatcaactgtcgaaccaaaacacaaacattggtacatccacaaactgcgactactactcatcaataaaaaggaatgaagtattgatatatatatatataatgacatggatgaatttcaattcatatcttcaatactaagatgaagaaaccagactcaaaagactatctcatgtatgattccatttatatgacatgctggaaaaggcaaaggtagagggggagaaaatcaaaccagtggttgcctgagttggaggagaggggaaaaaattgctacaaaagagcataagagaatattttggggatggtggtggttatatgattctgtaagtttgtcctaatttatagaagggtaaattttactgtgtgtgtattatatctaaatgaacaataaaacaacacacacacacccctaaaaataaaaagtgaaccattaaaagtccatcctggaaaggagttgtttgcctttagtcctacaagagatttaaatgtatttcaaagcaaaagaaataaagcagtggcttatttacaagaggataaacagatcactggaagagaagatgtgagcacaaaatcaacctcattctacatgataattgaatatgcagtaaaaagcggcctaaccaaaatgaggaagagaaagattcttcagtaaattgtcatagaatactaactaatgaacagcttttccatttagatttataactcacaccataaaataaaataaattacatatcaactttagataatcagtatcaaatctttaaaattaaatcatttgccaggactctaataaatttagaaatattataaataaatgacaaaaataaatccaaccatctaaaatatacattaccatacaaataaaatccacagagaaataaaaacaatgagaagatgatattcccagtaaaaactgcaaaaagagctatgtttattattgtacaatgcaatgtaattaacaagaaaacattaaaactctgtaatatactaattgggcaaaggacttaatctcaccagccataaagaagtaaacgtaactagtggaacataaagaagtaaatgtaactagtggaaatcaacttatggaaccattttaatatggtaaatattaagatgcatgttatttttaatcacagcatgctatcctgttatgtgtactgtgacactgatgagctcttctcttgttgctgatagtaaaaaattgaacatttagaaagacatatatgcagtataaaagtattcccttctctggtcatttttttacctttattatttcaaataaagaaagacaatatttacatgaagatattcattgaaaccttatagcagtgggaaagtgaaatcaacttgaatgttaactcttgtactggatagaatagtatgcagtcattactattttaattatacaaactataaaacagcatgggaagaaattgttatgatcttaaatgaaacaagcataatacaaaattgtatgcatattatctattcaactgtgtttttaaagagttgtgtgtagagaaaaagacagaagatactatttaaggacaacagtaaatgctcatacagctcacactgtgccgcgggctgtcctaagaccctgttgtgtgatagctcattaaatatcgaatactcacaacctcacaacttccattttgtcaattaggaatttgagctacagagaggttaagtaacttgcccaaggtcacacagtgcaattgctggtatttacatgcagcagccttttacctcttatgctatattgcctgagtcggctgtgctccctgaatcagagaagctgatgtaattatgttaagctgtggttgtgttactacaacctgtgacttattttccaatctttctgtaatattcttatttaaatacacacttcaaaaatgtttaagtagaagacatttagaggccctcggcggagggataaaaagtatgaagcacagtgaaggaatcacaactacccatctatgccaaaggaaattggcccatgtgctgcccagaggctgtaaaacttaaggagccaccagtaccgacctgaccagctgagaagctaatgggtgtgctgtatgagtgtatgtggggtgagggaaccggaagggcttcctgtagttaagattcagtggaagaatcacatatgtggagtcacacagtgggttgtgatgcagttgagtcaaatgtttgttctctaattcacctgggctcatctataccaacacattaggtagcaaggaccctgatttactagtcccagtgagtgatcattattttgcattatatagaaaaataaaaagaatgctggatgtgtttctgttttgtcaatgaactcagtttaaaaaaagtacagactgcccagatccatatgaaacagttataacagttgtatgcaaagctatatagctataggctaaattacttattaaagtccattggaacaatattgacttaaaaagttgtataatttatctatagttttggaaacagaagagacaatttactgtcaatgctttaggctgcaattggggaaaataaaaattataaaatagcccatatttttaaaaatatcactatgggaaaaaaaagcattgactctgttactttgtcatctaaatgtaacgcatgtttcttatttggcagaaaagccagcaattcctgtaataaaagttaccctagaggatatgtaggaataagcttagaaaaatgtgaataaaagaaatcataaagaattacttggagctatagttgttgatcatgaggattatatttgacaggaaaatatatcctttgggaaatcctattaattcttaaaagaaaatttgctacaccctgtacaattgttgcagaatgtctgatgctaaaacctatttttattgaatttgggcaagaagggtttctaatgccctgaaatctaccctacaggaaatgtaactacgaaaaaaaaaaaaaaaaaaaagaaaagaaaagaaaaagtaaaagaaaacaaccaaaacattagcaatctaagtttataaatattggatggacaaagcatctagatttataaaaattttacttttgatttttgcacacagaatttcaaaaataaattcttgaaatcaagaggaaacaggtatgcctaatattttaagtgctacatagtttacataacacatcatgaaaagattaactttgcaaataatttgatcccctttttttctcccaccccaattgtctttcaatcttcagtgaggatagtttttcattccaaaatgcaggttaaattgtctctaaataaaaaatgtctggtttcagatggacacttattcactctgaaaacaggctatttcttatctttttattaagtgtattgatctccttttaagcatttttcaataataattattctccactatctgtttgatgtcctagagtcctgttatatagatatgagaccaaaatatcccagcttataaacaacctctaatgcttcaaatagttatttggttttatgaacatggtttcagctttgctttgtttttgaccatttcacagaatctgtcaaaccacgaacatattaagcaaacttcaagatttctgaaaacaacacaattagggatgatggactgtgtctgcaaggtgtgttcctgttggtctttgttctgaaagctttgacaacttctaaaatggtgtgccaaaacttgctaaattgccaaagcaattttaaggtcctgattaaatagagtatcttatgaataagtatattggttaagttctgcatttcagaaagcttaatccccaaaacttattatttcaaaatctctctaaacggtatccagatccattattttattaataatagaatatatgtaaatacagaaacagaaaatatagatagggatcccaaacacatgcccacaggagccagacaggtaacataaaggagtgagtccagccagatgtaagattaggtgggaagggagcttaaaggcacatgaagaactaaagaattcatatcccacctaatagccaaacaaaacacattccctggtcaaatttggctcttgaggaaccactagtcagagacctccagtgcagataaattgaatatgtcctgtatccatccttggatgtttttgacaattactttaaaaagtaagctttgacaataatgagatactacttaacacccagtaggacagctattatgaaaaagatggataataacaagtattgataaacacgtagagaaattagaaccctcatatattgcaggtggaaatgtaaaatgatgccattgctgtggcaagcagtggcagttcctcaaaaaattaaacatagatttatcacatcatccagctactccactccaagagaactgaaaacatacatctatataaaaacttgtacatgaatgttcacagcagcattactcatggacagaaagttgaaaaaacccaaatgtgcatcaactgatgaatgaacaaattgtggtatactcatacaatgaaatatcattcagccataaaacaggaatgaagtactgatacatgttacaatatggatgaaccttgaaaattatgctgaatgaaagaagctggacatagaagaccacatattgtataattcagtttatatgagacgtctagaatagacaaatccataaagacaaaatgtaggttagtggttgccaggggctggagaaagggagaaatgggaaatgattgctaataggtatagggtttttttggcagggagtgaagaaaatggttggaattagatagtggtgatggttgcaactctgagactatactgaatactactgaactgtatgttttaaaaatagtgaattttattgtatttaaattatattccaataaaagtaaaggcttggtgtgagtttattatctattttacttttagcttcatgctgaaaacatagagctcccctcttaaccccaaacccattactaattttggagtttcttgtacttaaatttttcatatatatgatctcaattctgtatctcttttaggcaacttcaaaaattttcttccattagctaggagtcactccagttggatataattaggaaaagaagcatttgagagctgggagtagaaacaggaattaaggcaaaagttatggcaggagttgaagctttcataacaaggtcttgggaaaaacagaggaaactatgggtaagtaaccctcagtttagacaaggacccacatttctgtgtctgtgagaaggcaaatgctgagctgtgtaaaccagaaaccagggatctgtacctcgaagctgccacttgggcctggttaggatgtagaagcctctgaaagttgacagctcagagttggaaaaactgaaaagaatctttggttgaagggccagtcacaggagaacaactatgtttcttagtgggcagctcctctctgaccattcaaaatgactttacaggcatcttaatgaggcttcaagggagaatacaaaatgtttaacgtcagttaagggctgataaggcaaaatccattgtattgtactcactagcattaatttatgatatatagtatgccattgatatgatcttgagatactagtgggttgagtttattgcccacaatatttataacacctttaatctgaatttctagctttatttattctataatgtcttaaattcttcaacttcagattatcttgtaaaagaattttcatttgtgtttgaagaggtaagctgttgcatttggttgaagaagttcaaaatatttaggtataccaaacttttataagagtagactcagtagttttaatttttatttaagctatcagtgtgcactatgaatagaatacgcaactaaaaacaaagcacaataaaaactagaccattaaaaaatggaaatacaaattatggtaaatttatataatgtgatgtacagcaatttctaaatgttattttatttttaatcggcaaatcataattttctatatttatgggctacaatgtgatgttttgataggtacatacaatgtggaataaaatcaacctaattaacatatataccctcatgtatctaccattttgtatacagacatttgaaatttactcttattttgaaaaatacaatatatttttattgattattgtcactgtgctgtggaatagatctcaaaacttattctgtctatctgaaactttgtaacttttgcccaacaattccattccttcctttccccttccccagcctctggtaaccatcattctactctacttctatgagcttgacttttttagattccacatacaagtgagagcatgtgggattcatctctttgtgccttgattattttactttgcatagtgtcctccagattcatccacattgtcacaaatgacagaattttctcctttgttaaggctgaatagtgttccatagtgtatatattccacattttctttattcattcattggtggacacttaggttgagtttatgccttggctattgtgaataatgctgctgtgaacatcagagtgcatgtatccctttgacttactgatttcaattttttccggatatatgacaagtagtaagattgctgaatcatatgatatttttaattttctgaggaacccccatatcattttccataatagctgtactaatttacattcccactggcaacatacaagagtttccttttctctgaactttcaccaacacttgctatccttcatctttttgataaaagctattctaacaggtgtgagatggtatctcctagtggttttaatttgcattttgctaatgattagtgatgttgagcattttgtccatgtacttgttggccacttgcatgttttcttctgagaattgtctgttcaagtcctttgcccattctttaactgtgttatttttcttcttgctattgaattctttatatattttagatgttaaccccttatcaaatgtatggtttgcaaacaacttttcccattccatgggttgtccctcactttgttaattgtttcctttgctgtgcaaaaactttttagcttgatataatcccatttgtctatttttgcctttgtcatcaatgcttccagggtcatattcaaaaaattattgcctagatctacatcatggaactttttgtgttttcttctagtagttttacacttcgaggtctcattttaaatcttttttttttttttttttttttgagatagaatctcactgtcacccaggctggagtgcaatggcatgatcttggctcactgcaacctccatctcctgggttcaagtgattctcctgcctcagcctccagagtagctgggattacaggcacacaccaccacgtgcagctaatttttgtatttttagtagagatggggtttcaccatgttggccaggatggtctcgaaatcctgacctcaggtggtccacccacctcagcctcccaaagtgctgggattacaggcatgagccaccacacccagccttaaatctttaaactactttgagttgatttttattatggtataagaaaatgatccactcttatttttctgcacatggataaccagtttccccaacaccatttgttgaaaagactgttctttcttcattggatgttcttggcacctttgtcaaaaggcaattcactgcaaatgtgtggccttcatttgtgggccttctatcttgttcctttggtctatgtatctgtttttatgccagtaccatgctgttttgattacaattgctctataatatgttttaaaatcaggaagtacaatgactccaggtttgttccttttgctcaagatcattttggccattcagggtcttttgtgttttcatatgaagagttgtattttctattctgtgaaaaaaatggcattgaaattttaatagagatagcattgaattttagatcactttgggtactatggacattttcacaatataattttttctacccatgagcatgaaatatctttttatttatttgtgttttcttcaatttctttcatcagcatattacaggtctttcacctcattggttaaatttacacctaagtattttgttgttgttcctattgtaaatgggatggtgttcttaattttatatttggatcatttattactagtatatagaaatgctactgagtttttgtatgacgattttgtatcctgcaactttactaaatttatcagctctaataggtttttctggtggagtctttagggttttctctatataaaatcatgtcatcagcaaatagaaaccattttacttcttcctttcctataaaaatgtcttttctcttgcctaatatgcatcaattttttaaatatttacaaaggtttaaaaaggcatgaggaaattcacataatattaagccagaaaaatagaatgccaaattttgtgtatcatgcaatgttaatatcagaaaaagttcagaataaagattaaaattttggcaatgattatctctagtgagattactaatgagtattatgctttttatatgtttctgaattttctaaattttcttgtatatactttaattcagaaaaaaacttcaaacattcactaaaataaagttcaaaaaaaaatctaaaagccaggtctgagaaagctgaaattcccagatgtcattgtatatgatggaacatatgcaagaaggataagacaacatgattctgtcttcaggatgtagaatagcctttatgtcatgagttttgcagtattccaaaggctgtcaattttttcacatacggtcagatcaaaactttatataattagacaagttgatttagcttctaaataacaaacacatttatttttcctaatagtaggcaattaattacttggctagttttaattcaatttcattttgcactggatatttagacatataagctgtaccttaaaaaaaggatttccctgaatggacggttaactctccacctctactccacccacatttacagatgagaaaactgacaccaaggagatatgtaggagagaaaaatgattacaagcattcaagattcaggtccaaagtactcccaatggatttgttgtttgtgaactaatatgcactcatggagcctctataatgtgcagctctatgcaaagctcttttccttacatcatcttgtggaacccccataacctcacagtaatgaagacgttatttctagctatactgtggagttggggaaaattgttaggctcagaggttatgagaatttctcaggatcactcagctagtaagtagccaaactggaattctcatgtagaccatttgactctgaagcccaccagccttctaacacatagaaaacaacaggttttattgtctaaggtcatggctttccatcctcaatatccttggatatggcacatttgctacctgcctctacttgtagctacttgagtgagtcatggtcagaatccatttttctttggtgttaaagaatgcttttgaaagggataaaggtggaagatacttcctgtttggcacagtgtatgagtatgtggttataataatcatctcttgccccactattctcacaagtttttagaaactcctccctcagaagatgccatcactggtagttgatcctgggaagttgcccagtagttgttccacatgttccctctgtaccaaaacatagacaaatccaattttctcactctgtttctaggttgatgtcaatttgaatcatggcttgatgaaagagagtaaaatgatgatggcttggaataatttaatcttacctctatataaaatataatttctttgggaattttgtgggtttttcttttcttattgcttattctctcagcatttattataaatcccttctctcaaaacaaaagaacactaacatctctctcgtttaacagagactgctttaaacattgctctctcctcccttcccacctcctctttgactaaaccaagatttttcattgtgaaggtttgactcatgataacctaggcaaagaaaggtcactttggtgtctcttatgaacagcagcatcagcaacacctgggtgtcacgcacgtccttgtgaacagagtccaccaaataggcttcgtttgagcaacaaggctgtttatttcacctgggtgcaggcagggtgagtccgaaaagagggtcagcgaagggagataggggtggagctgttttataggatttgggtaggtagtggaaaattacagtcaaagggggttgtttctctggtgggcaggggcgggggtcacaaggtgctcagtcagggagcttctgagccaggagaaggaatctcacaaggtaatgtcatcagttaaggcaggaaccggccattttcacttcttttgtgattcttcagttacttcaggccatctggatgtacacatgcaggcttggcctcagaggcctgacactggggtcttattagaaatgtaaattatcaggctctagcccagacctactaaatcagaaattctggagatgtggacccagccaattgtgttcttaaagccctgcagatgatcttgatgtaccataagcatgaaaaccatgtccatataaatgattttcttttaaaaaaaagttttaggtgatacagtctacagctctgaagagatcactaagatagagtgaattaagtgttctgtattgactgtacacttactagtgttggcagataaaatacaagatgtccagttgaattgaaatttcagatatacagcaaataaaattttggtatctcccataagatatttgggacttacactaaaaaaaagttgtttatgggaaattccaattttactaggtattctgcatttttatttgttaaatctggcaacctgatcaccaacccatttttctgtaagtgagttctgagaggtaggagtaactgccagtttggtgggaccaggtaacttttcttgttttgactgtacagtagggcaagctggtaggaaacactatgtaattcctgcctgtgtcttttataagccctttgctgcatgctgtgatttgagaaaatggtaattactatacttaacatttcttgtttattttgtatcatggaaaaagagaatgtcttttctccattttaaccttaataagaaaacacaaggtgtcttcctccagagaatttcagaaaatcgggcagagtggacaaaatgaaatggaggttgtggggtgattagaaaaataatagaatggcagtcaggaagctggggctaattttttggtcaatttgtgtgttaggggaggtggtatgagcgtatgtgtatatgcatgggtgcatgcatggatggggtatacaagattagaaaactaatacttaactgaatttctactggtgtcaggcattgtgcacagtgctttgcatatcacgtatttcatcttgatgttatttcagaaacattccttgagaaaggtatgttgggacaaggtagcttaacacagatgtcaatattgcccctccaatgctaagtgtgcttctccaagaagccattacctctgctttgcctgcataggtaaaagaagacacctatttatatttattgcccatggcttcccttcaagaaggacgtatgaatacttttagaagagagggaaaatatgtcctaaactgcaaggagttcaattctgaggttgccctgaggagaaatcttctaacaagcagctatggaagcattgaatgattcactgagatgtaacacgattccagagagactcagctgaatgtggttcacaaatgtaatcatcttattgagtaccctgatctaaaggtactaattatgaagcactgtgaaaatgacaactgcatttattaactagtttacataaatatgtatttcttaaccaataatagaaatagtttgtctcaatcttgtttttctagtatatgcacactttagctactaaggattaaggagagagacataaacagccaaacacccctcccatctcctacctctgaaatgcaagaggatttcagatgggagagtaattataggtcaacagaaaccacatggtcccttacactctccaactaccacctcgggataagcatgacagtggagaaaagcctgcagtcacatttctggcaatgcccaacagtgagtagtacattttcattgaataacaaatgtcaaatggccaggcagtgggagaacagaaaggagaaaagagacattgggccccaggggtctggactggatttaaggaagggcaggtcaaaattcctaaaactatttgtaactttccataaaatttaaaccaatatatatcttatcactcttcaaagcagcctcccgaccaattagtttagctgcaatttggggatagctgacagagctcccactgtttttcactagccattaaccaagcagctgttttgggagattttttttctaaacgaattcaaatttaggaatcacttttatgggcactcaaattgctcttatttctcctttgcggtcaaagatgctggttttgtgatttctatccgaaagacaagggattgcttgacataatgatttcatttgctttactgggtctacacagaattttatttaatccacagaaagcagtgggagaaacgagaacaacctgaaggacaggaaagtatgtctgtccaatagtatagatactaaacattggcatgtgacatttgaaccctgcaggcattcacagttatttaacagatgcttattacatgctttattaagccaggtgctgaaatgtggtgctaaggagcccctgataaaatacagcaggatatgcatgccaacatcagtgacaaaaaaaatacttttgatttggagatattccataaactcaaagtttccagaaagattataaaatataacttactttttaacttcttgcattttattaaatcaacacactattcagaattaagtggaaatgaaatttgtgataaaattgatcatttttaatctttagatatttgttttctgtatcaataacagccttgaactactatgtatgcatggctatatacagatttgtatgcatatataaatgcatgtaaatatgtatgcatatattttgcagtgttctggcacaatgtagttgctcaacagatagtaaccattattattactgagtacagcaaacccacatgatgatgtgataagtggaagtaaaacaaaaatccaaatgtggagttactttgttgtgtagtgaatttaaaaaaacaatattttcatctggtctacaatccctcaaaagcctacaatataaatttaaaagaggtatttacagaccacagtgcaaactaagagagttccaaagaggcattgctttctcctgcatttaaaaatgagagtggggagggtaccagagacaccacatgggaacaggcatgatcataggagtttatactgtactccaattagttgaaaattatgaacatgcatgttacatggtagctggtaaaccagaacgttcaactaaccagttgcctcatttctcaaacatttaatacaaatgaaaacgttacgattttattgaaagtatattttaatttgtgttccttaggctatatcaatatgacatcattgaaactaactgaaaagtgaaaaactcaattaagggaaaatgtgatattttcaggcaatccgtgtagttggaactatcattgcttagataattatggccagagttgagtttctcatggtagagtccacaaaaatctccatggtatgaatgggaatggcctgttgacaccataagtttttctaagccagaatcagaatcaagtgagtatgtcattatgtggcaggagaggacctcctctatattttgtcataacccaaagaaaagttcctgtcttcttaaatgcgggcatttatcttctttgaaaagtcaaacgagaaactctatttaaatatcaatcatgttgcaacttctgtgaggaaaaaaaaacctgcataaacagttgcctaggctgattaaaatcatgttattatatacaaattaaaactattgaccatttaggagaacaattacaaagctccacaatgcattggcacagaatcccatcattgttttctgtctgagccaaagcaaagtgactctttcggttcctacagctcattaatttccaagctgggttattaagaaagataatgtttagtttttcagcatgttggattctcctcttctttttggtttttaaagagtaaatggacgttttacattcaggacatggatagtaatttcataactctgtctttattatctcatatatttgaccttgaggaacagaacaagcgccagacttttctacttttctcttggccaaacagaagcagagttctcaaaatcaatgtttggtcctaaggaaatttcaggaaatactttcttccctgctccctcatacttcctggatatccacactttcccagaatcatctcagaatagctttactatgtctaagaggcaaggagaggatgagacaagctcaggagccagcctgcctggggtcaggtccgtagtggctcacttactgctctgagtgactttgaatagttacttcatctctgatgttcagtaaaataagaaaaacatctataaaataagaataacacacatagtaccaggcttattaagtaagcacgtagcaaatgtcgatggggaaaaaacattctggaaatctctgaagggcaacattttggtggagtagaaagagctgtgcttttggaaattaaaccaattggctgtgagatattgggccatctcttagcacttactttctcctaggtaaaataggagaatataatcactttatgtgtgtttgtgaggagaaaattaaagtaatatgtttatggcaaatattgttgaaagagcatggactttggcttccaatggagggtttgaattgtggctcttcctcttattagctctataatcttgagcaagttgtccgtttccttatttgtaaaacaggcagcataatacctccattgcagagttaccaagagaatttaatttctataaagttcctaatgcatagtagggacttgataaatggcaggtgcattgtttgtgaactattttcttgtccataacacactatgtagatattagctacaaacctcatcactattattttgctgttctagaagttgggccagtaagccttcttccaaaccccacttacaacctgcaaaaatctttatcagttcctacctcccaggtgccaggtgtatgtaccacaaactttggaactcaaaagtcttatgacttttgtttgaatttttattgaaattatacatatttaaggtatacagtgtgatgttttggtatacataatgaacttattgttacagttaagctaattaacacatccatctctttatatggttacctttgtgtgtgtggtaagaacacttaagatctattctctcagcaaatttccagtatacaatacagtattgttaactacagaccccatgctgcacattagatctccagaacctattccctctaagtaactgaaactttgtatcctttgataacatttccccatttccccctaccctcttccccatgtcccagtaaacaccatcctattcccggcttctatgaattcaaggtttttagattccaattgtaaatgagaccatgcagtatttttcttctgtgactggctatttcacttagcctctaggttcatccatgttgtcacaaatgggaagatttccttctttttaagattaatatttcactggtaataggaaacattccttgatctgtatgttttcttctaggagttttgtgatttcaggtctcatgacttttgaagtctcagaatcaccatgtcttctgatgccaaaagaaggcactccctcaggaaggtggcctcatttgtgatatgtttctgcagcaaatatcagaaatccagactaaatatatggggatttatttatgtcacacagaagatgcagggaaggcaatgtgaagctggttcagcggctcagcagcgccaccacaggcatgggctccttccatctacctggtgtttctttttcagtctgtagcttttgtctccatggctgctgtgcaaacacattccatatctcacaggccagatctaggtcacatagccacctctagctgcaagggagtctgaaataaatatttaattggatatattgttgcctcaaataaaattaggattctaggagcacaagagaaggggagagtagatattttttggcagctagcaatgtctccagtagtctgaactcttggagaatagactggtgacaatgagctggtggcaccttcaacagagcagaggcctgctcaggttgcttcagaagatggctttgcactaagattctagcaattctaagattcacctgtcttctattatatggagcaatgtggcttttcctgctttcagggaatgtgggtgtgcaattgagagaagtagttcatatctatggtggttgctttgttgtgatgtgattgattttggtttgttttagtttgcgtcagtttcattgcttcagttcgtcttcatttttctatggtttgcaagtgcctcaggtgtccaggcaaacacactcctgtatcccatggtttacggctggaggtttgtctccctcaggagacaaactttttggatgttccccacattggtctggaccctctttttagctgacaagacaccctgccaggcatagcacagcagtgcaggagcagccacccacatttcacagttggagctgcttttttccatgtgaacaggggagcactcaactgaaatataaattctatccaaataagcttggcccaactccacacaggcctgaggtgttgctgtgaatgctctatctgagaagggaagataaatcaaacacataaaactgagattggagccataaatacgaaaaataaatgttaatgtccatagcaggcctgtgtgatagaagcccacctaagaaaagtgtctattcttgtttgctacaggggatcttaaagggaggcagaatcaccttcttagtatgaaagttcccctcatcacaagggaaaataaaaattgttctgcactcccttcaacccagtggctaaagtttttacgttagtcttttaaagtctctgttaaattacagatgctatttatgataagtgacatgataattagactttatcttccataacacatgatcttaaatacatttatcaaattaactctagaaaattccactgagtcacagttttcctgggggcaggaattgtgctttttcccagcatccaagaacctggcatgatgctgggcacagatcaggcatcaaggaatgctggctgaacaggcacagaaagacaaactttacatgttctcactcacatgtgggagcaaaaaatcgaaacaaatgaaatcagagagtagaatgatggttaccagaggctgggaagtgtagtggtggggcaggagtggggatggttaatggacacacaaaaaatagctagaatgaataagatctagtatttgatagtacaacagagtgactacagtcaataatttattgtacattttaaaataacggagagtataaatgaatcatttgtgacacaaagaaaggataaatgcttgaggtaatggatactccatttaccctgatgtgattgttacactttgtatcgctgtatcaaaatattttatgtaccccataaatatatacatctattatatacccacaaaaataatgtgtttaaaaaaagaaatattggctgaagttgacagaggggatgggacatggggacagagggaaaggtctgaggagggcagagctgagagacagatggctctctcaggggacaggggtgagcactggctgccaagaagaaactagacatctggggagaaattgcacagaaagaaggccagagcagccccataaaaaagtcattctgtcttgtgcatttggcaaaagttatgctgccccttggcgccatcaaagtggagatcaggaaccaactgtgcaatgtcataggaaaaaaacaacactatggagaggataaatattcgtcaccaggtccagttctggcatctgcttcagatttatttttaaataaagcagatcttattaaagtaattagccaactgtgagaattctgctcctgattctggaattcccaagataatggagcacatgttgaataagaagataactctaagcccctgtgtttctctagggtctttttttagtacatgcttattgtccaaattcataagtgttgagctaacgtaatgttttaattgttcttgctcctctatatgcaatgatagaatgcaagccatagcactgattaatttcaaattttgattaagtgataagaaagtccttttcatcttttattttaatcatgcaatagttttgtgtatcttctttgtaaatttggctttaaaatgaggtgctgatactcattttttgattagtaaaatatttgccctattcttccattctgcccatgttgactccctctatctctgtgaatttgtgttctactaaattagaccactaagccagaaacatttatttatttaagaagacttttactattagcctgatagaaaggagtcaacatcttgtgctaattcatttcattacatacacacactatccctgaatttgtctagtaatgcttgtgataaggagataaaaaccatcttttaatttacagtacaaatgcttcactctgggctttctaaaacattatttgtgagagtgtaaataactgataaaacaatatatgtcaatattttaagtatgtatgctctctgaccagcattcgtgtctagtataatctgtcctgctgaaatacttgtacataagaattacaatgaatgttcaatactgcagtgtggattgaaacagccaaaaattgggggaaaatgcatgtgtttattatgaacaaagtggtcaaataaacaacaagacagacatatatttaattaaatatggttaaattatatttaattctatagcatttttaaaagatgatctatttgtacagagctaatagaaagaattctaagacatgttgataaacaaggtggtggtgaaacaatgcatatggtctggtgtcttttatattaaaaaaattatatatttgtatatttttatatgtatgtaattttgtagaaaggagattggaagaatacacaccaaattatcagctctagttacctctggagagaagaggggctgagtatgaagaaggtcctcagcattttgcttatataattgtatataatttgagtttttcacaatgagaatgtattcatgtaactgctgagtaatttttgtttttgattttgttttgtaatttatacaaatattttacaaatgtataaagtacatgtgagtagtttttacatgtatagaatgtgaaatgatcaagtcagtgtatttggactatccatcatcttgagtatttaccatttctatgtgttagtaacatttcatgtcctctcttagttactttgaaatgttcaaggcattgttgctaactattgtcaccacactgctatggaatgttaaggctaactttttcttagatctcaccttcttcaggtttaaaaatgtaacaatatgcaaatttttactttcaaataaccaggttctgtgagtgccatgacttgatgtacaaagaagaaaggatatcaggaagagaaaactagagtagttcaatgaatttttatagctagatgtgtcattaccaaacacacacaaacactcaacttcattgagttacccaagcaatatttattgagtgcctacaacttgtcaagtgctaagataaatgccaaagtgcatgcacacaaacatacagtggagaaatgatgaatctaatattgaattaattgatttcctattaaggtgtaccaaagctgtggatataaaatggagccctcgtgtatggagaggagataaattctaagatttacactgcaaactccacagaaggaagctgtgggttgtcctagggtggagtgagaggaattaatctttagattttcacttgtaagataactggaaaaatgattacttatacagagagatgccaagaaaggaaggagaattgattcagtgagtatggctctacaccaagaagtttagaatctgatttttaagatacttctcaactttaccaagtaagatcctggcttgagtttcacctttaaagggtcattcaataataagatgtcccatttaatttacatgtttatgaactcattaaaattagtagtttggacatagaccttttgcaaattctgggcaggtaggaagacagtaacatcagtgctgagcttcagctgccacacattcaagactgagacagtggggagccaagatggccgaataggagcagctccagtctacagctcccagcatgagtgacacagaaaacgggtaatttctgcatttccaactgaggtaccaggttcatctcactggggagtgctggacagcgggtgaaggacagtgggcgcagcacaccatgcatgagtcgaagcagggcgaggcatcgcctcacccaggaagcacaaggggtcagggaattccctttcctagtcacagaaaggggtgacaaacggcacctggaacatcgggtcactcccaccctaatactgcgcttttccaacgggtttaacaaatggcacaccaggagattatatccagcacctggcttggagggtcctaggcccacggagcttccctcattgctagcacagcagtctgagatcaaactgcaaggtgacagcgaggctgggggaggggcgcccaccaatgcccaggccttgagtagttaaacaaagtggcctggaaattcgaactgggtggagcccaccacagctcaaggaggcctgcctgcctctataggctccacctctggtggcagggcacagacaaaagacagcaataacctctgcagacttaaatgtccctgtctgacagctttgaagagagtagtggttctcccagcatgcagctggagatctgagaacaggcagactgcctcctcaagtgggtccctgaccccaagtagcctaactgggaggcacccccaagtaggggcagactgacacctcacacggccaggtactgctctgagacaaaacttccagaggaacgatcaggcagcagcatttgcagttcatcagtattcgctgttctgcagtcaccactgctgaaacccaggcaaacagggtctggagtggacctccagtaaactccaacagacctgcggctgaaggtcctgactgttagaaggaaaactaacaaacagaaaggacatccacaccaaaaccccatctgtatgtcaccatcatcaaagaccaaaggtagataaaaccacaaagataggggaaaaaacagagcagaaaaaccggaaactctaaaaatcagagcgcctctcctcctccaaaggaacacagctccctagcagcaacggaacaaagctggacagagaatgactttgacgagttgagagaagaaggcttcagaagatcaaactactccaagctaaaggaggaagttcgaaccaatggcaaagaagttaaaaactttgaaaaaagattagacaaatgggtaattagaataaccaatgcagagaagtccttaaaggacctgatggaactgaaaaccacagcacaagaactacgtgacgaatgcacaagcctcagtaactgaggcgatcaactggaagaaagggtatcagcgatggaagatgaaatgaatgaaatgaagcgagaagggaagtttagagaaaaaagaataaaaagaaatgaacaaagcctccaagaaatatgggactatttgaaaagaccaaaactacgtctaattgctgtacctgaaagtgatggggagaatggaaccaagttggaaaacactctgcaggatattatccaggagaacttccccaacctagcaaggcaggccaacattaaaattcaggaaatacagagaatgccacaaagatactccttgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagatgggggaccaatagtcaatatttttaaagaaaagaagtttcaacccagaatttcatatccagccaaactaagcttcataagtgaaggagaaataaaatactttacagacaagcaaatgctgagtgattttgtcaccaccaggcctgccctaaaagagctcctgaaggaagtactaaacgtggaaaggaacaacaagtaccagccactgcaaaaacatgccaaattgtaaagaccatcaaggctaggaagaaactgcatcaactaacgagcaaaataaccagctaacatcataatgacaggatcaaattcacacataacaatactaaccttaaattcaaatgggctaaatgctccaattaaaaagcacatactggcaaattggataaagagtcaagacccatcagtgtgctgtattcaggaaacccatctcacatgcagagatacacataggctcaaaataaagggatggaggaagatctaccaggcaaatggaaaacaaaaaaaggcaggggttgcaatcctagtcttggataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagtgacctacaaacagacttagactcccacacaataataatgggagactttaacaccccactgtcaacattagacagatcaacaagacagaaagttaacaaggatatccaggaattgaactcagctctgcaccaagcggacctaatagacatccacagaactctccaccccaaatcaagagaatatacattcttctcagcaccacaccacaccaattccaaaatcgactacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataaaaaaatgaaggcagaaataaagatgttctttgaaaccaacaagaacaaagacacaacataccagaatctctggaacatattcaaagcagtgtgtagagggaaatttatagcactaaatgcccacaagagaaagcaggaaagatctaaaattgacaccctaatatcacaattaaaagaactagagaagcaagagcaaacacattcaaaagctagcagaaggcaagaaataactaagatcagagcagaactgaaggaaatagagacacaaaaaactcttcaaaaaaatcagtgaatccaggagctggttttttgaaaagatcaacaaaattgatagaccgctagcaagactaataaagaagaaaagagagaagaatcaaacagacgcaataaaaaatgacaaaggagatatcaccaccgatcccacagaaatacaaactaccatcagagaatactataaacacctctacgcaaataaactagaaaatctagaagaaatggataaattcctcgacacatacaccctctcaagcctaaaccaggaagaatttgaatctctgattagaccaataacaggctctgaaattgaggcaataattaatagcttactgaccaaaaaaagtccaggaccagatggattcacagctgaattctatcagaggtacaaggaggagctggtaccattccttctgaaactattccaatcaatagaaaaagagggaatcctccctaactcatttttttaggccagcatcatcctgatagcaaagcctggcagagacacaacaaaaaaaaagagaattttataccaatatccttgatgaacattgatgcaaaaatcctcaatacaatactggcaaaccgaatccagcaacacatcaaaaagcttatccactatgatcaagtgggcttcatccctgggatgcaaggctggttcaacataccaaaatcaataaatgtaatccagcatataaacagaaccaatgacaaaaaccacatgattatctcaatagatgcagaaaaggcctttgacaaaattcaacagcccttcatgctaaaaactctcaataagttaggcattgatgggacgtatctcaaaataataagagctatctatgacaaacccacagccaatatcatactgaatgggcaaaaactggaagcattccctttgaaaactggcacaagacagggatgccctctttcaccactcctattcaacctagtgctggaagttctggccagggcaatcaggcaggagaaggaaataaaggacattcaattaggaaaagaggaagtcaaattgtccctgtttgcagatgacatgattgtatatctagaaaaccccattgtctcagcccaaaatttccttaagctgataagcaacttcagcaaagtctcaggatacaaaatcaatgtgcaaaaatcacaagcattcttatacaccaatcacagacaaacagagagccaaatcatgagtgaactcccattcacaattgcttcaaagagaataaaatacctagcaatccaacttacaagggatgtgaaggacctcttcaaagagaactacaaaccactgctcaatgaaataaaagaggatacaaacaaatggaagaacattccatgctcatgggtaggaagaatcaatatcgtgaaaatggccatactgcccaaggtaatttatagattcaatgccatccctatcaagctaccaatgactttcttcacagaattggaaaaaactactttaaagttcatatgcaaccaaaaaacagcccgcatcaccaagtcaatcctaagccaaaagaacctggaggcatcaggctacctgacttcaaactatactacaaggctacagtaaccaaaccagcatggtacaggtaccaagacagagatatagaccaatggaatacaacagagccctcagaaataatgccgcatatctacaactacctgatctttgacaaacctgagaaacacaagcaatggggaaagcattccctatttaataaatggtgctaggaaaactggctagccatatgtagaaagctgaaactggatcccttccttacaccttatacaaaaattaattcaagatggattaaagacttaaactttaaacctaaaaccataaaaaccctagatgaaaacctaggcaataccattcaggacataggcatgggcaaggacttcatgtctaaaacaccaaaagcaatggcaacaaaaaccaaaattgacaaatgggatctaattaaactaaagagcttctgcacagcaaaagaaactaccatcagagtgaacaggcaacctacgaaatgggagaaaatttttgcaacctactcatctgacaaagggctaacatccagaatctacaatgaactcaaacaaatttacaagaaaaaaacaaacaaccccatcaaaaagtaagcgaaggatatgaacatacacttctcaaaagaagacatttatgcagccaaaaaacacatgaaaaaatgctcatcatcactggccatcagagaaatgcaaatcaaaaccacaatgagataccatctcactccagttagaatggcaatcattaaaaagtcaggaaacaacaggtgctggagaggatgtggagaaataggaacacttttacactgttggtgggactgtacactaattcaaccattgtggaagtcagtgtggcgatttctcagggatctagaactagaaataccatttgacccagccatcccattactgagtatatacccaaaggactataaatcatgctgctataaagacacatgcacacgtatgtttattgcggcactattcacaatagcaaagacttggaaccaacccaaatgtccaacaatgatagactggattaagaaaatgtggcacatatactgcatggaatactatgcagccataaaaaatgataagttcatgtcctttgtagcgacatggatgacgctggaaaccatcattctcagcaaactgtcgcaaggacaaaaagccaaacaccacatgttctcactcataggtgggaattgaacaatgagaacacatggacacaggaaggggaacatcacacactggggactgttgtggggttgggggagggatagcattaggagatatatctaatgctaaatgacgagttaatggctgcagcacaccaacatggcacatgtatacatgtgtaacaaacctgcatgttgtgcacatgtaccctaaaacttaaagtataataataaaaaaaaaagactgagtcagacttaccaaggtgagtgcatgctaactccttcatattcaagttgataccactctttatcaataaagacccttgataaatgttctatcacatgttcttcacagccacattataacagttaagtgtttattgagggcctaagatgtgtctatgccacgcctgctgctttatatggaccatctcacttaatcttcaaaaccacccccaagtatgtattattatcacattacaagggaagaaactggggcccagaagggctaggaaaactgccagtgtcaccacatggcagaattaagatgccaatatttatctaattttgaagccagtgtgttgtctcctaaaagaagatgaataagaagaacaacaagcagaagcagaaagaaggcaggaagggtgagagggagggaagagcgaaagaggaagaatggaagagaaggagggagtgagggaagaaggaaacactatgattgattatgttgttttacacatttaaaattgagtactgcagaaattagtttagtttgccaaagtcacaactagtaagtagcaaaatccagaacaaagctcacattacccaagtaccctccctaccgtgccactgctggctctccgatgtcaagaaataactaaccatggcaaatctaacaattcattatgtgctcattttacatctgtatattattttccctaaaccattactggaagggcagaaacttatttgaattttttttctctctccctgatagaaatagtttttctcaatcaagccataatgtagaagtgaacaaactatgtattatacattcaaattacacagagcaataaataattgtcaaaggaaataagcaatgatttccaaaaattcaattgacatccccaattagatctacataaaaagatcagccaattaactctgccaacagctctatttcgttattctcacttgcattctaaaattttgtttatataattacttcagaaccaaaggggaagtaaactcatttctatcttttaaggaataattgtcttgttcaaagagcagcaattttatccatgaatatgaaaaagatgcaaaagaagaacaaccagtaattccttgtaagagaaaattgctctgggttacaagaaaaagaaaaggttaggcagattaactaaaaatagtctaatcatttttgtggataaatgtcaaaggaaaaggaatagaactggtagtctctgttttctccttgacgtaagcaattaccaacagagctgagtggaggaagtctgccttaaggtggattctttacatggaagtttaggaatgtccattcttcaacattagggaaagggacaattatgctcccacctacgtatcttcaaaataccttttcctcaagactaagtcacactttgcctaaaaaaaaaaaatcagttatcaaaaatatataggtaccaaaatgctcacagcagtcctatttatgatagcaaccactagaaattactaacgaaaagagaataactaagtaaattatggtataaacatatgccatatttctttgatccttagatgtcattgattgcaagtagcaatcttattttacaggcttctttggggaaaaatatatatgaaatattcaccaaatattgttaaccaatattgccacttatctgtgcaattatacattctttcagtcaagagtggagtcttcattggctctcctagtagaaagtctcatctgagtgccttgaccctgggcagcttgtatagctcagcacagatatgctgcttttctaacccaggccttgatttcaaccccacccccattaacacctttgagattaaccatttaatttcgaggcacttgaaagaatatcaaagttctgtctgcatttctgcattggttaaactcatagttctttcctctactgaattactcataccatatattaaatagtttctcttcaaagcagtctgtaagtttttgacagagatgtttagtgcctgagtcatgggccatcacaattcaggatcagtcacatctattctcccagctgaaaatactacgatctactctaaagaagctggccatttctactgcctttaattccatcgcctaaggtatggtaggctttcttctgcatacaccgtaacttttcctttcaaagccccatcatactgtgatccttatgaagacattaagtagtcatacggatccacatttatgttaaaagtcaaacatatttggtattgccaagtcgactgagatgataatcaaatagactgacactttctactcttaggatcacacagtctcaggtattcataactattatcagcatcacctgggaatttgttagaaatgcaaattatgtagccccacctccaggtgactttgatacatgctcaaattcatgagctactgagatagtattcaaaacatctagtgcatagtaataatcatagctaccaatttctaaatatgtaacaagtgaaaggtattatgctagttgttttacatgcctagtattacttaactatcaccataccccaatcaggtatcactacacccattttataaatgaggaaactgaggctcaaagaagctaaagagcttaggtttattccgtagtccggtttctcattttgaaacatcagtgtaataaatcacaagttcaattacttggtcagtcacatgcttatcagtctcaattagtttatcccctcattttatacatttttttttttaaaagtgactcccggagaaggaaagcgacttgccaagactcaaatagttaatggaagagcctgaagtagaactgaaatattgaagttttcagtctgggctatttccatcacaccacactgccactaagtccagttttttgtttttttgttttttttttaatcaaaggaaactctgattttaaaataacaatgcgtatacacgaaatgtcactctcaggatgtgtgtttgattcctggagaaaacactgttttcccctgaatactcatgaatctcagatacgtgccagggcatttcaaattgttcttacctgtgccctcttaagatttatattgttgacattccttaaatagttagcttagttactgtatcacaactttcttgttttcttgacaacaggtattatttcatgcccttaaaagaaaaaagagaccaggctgggcatgttggctcacgcctgtaatcccagcactttgggaggccgacacgggcagatcacgaggtcaggagatcgagaccatcctggccaacatggtgaaatcctgtctctactacaaatacaaaaaaattagctgggtgtggtggcgggcacctgtagtcccagctactcgggaggctgaggcaggagaatggcgtgaacctgggaggcagagcttgcagtgagccgagattgtgtcactgccctccagcctggcgaaagagcgagactctgtctcaaaaaaaaaaaaagaaaaaagagaccaaaaatattattgacccccatatgctaatatgttgcaaattcttggtacccttttagtattaggatatttgcctaagaaccaaactgttattctggaactttccccaaccatatttttcataattctatgttatacttatatattgaattgtctattttccaattaaaagctactctacttatggagtttactctggttcctactcacaaattaggccttaattctttttaataaattgctttaatcaacacaatagtgatgctatactgtacacttgtgtgtagacatatacacaaatggttattataataaaaagttttggaagttactcaatgcttttctggaaaatttcagccaactagggctaggacaaagtgatattttacacttgagctgggaaagaagctgagttgtttatttggtttttaaaccagaaactcatgaaatatgacatctaattctggctgtgttcttatctattgctgtgactgctcgcagcttattggtccccagttgaggacatttatttcctcatctattaaaaaggatggtaaacagttgcctaattctaaagtttggaaacaaaaggaattctgtagcttcactaatttagtgacagatttaattcctttacaactcctgccatctccaaaccttttaattttccccaaaagcaaatttacattttattgctgataaagaacatgatggagacttgcctaattaccacttgaccaggataaccagataaacagtgtcaggaattaaaaatatggcacaaaactatggccttccatttatgtgttaataactcacatggtattctcatggtatatataaatcccatatactactcaccaggtcttggaatattctgctagtaaaccatgtgttatagcagagtaatacttttttctcaaattatgattactcaatttcatacatagcatttctaaaacttaatagtcacctataatgaatagtatagtacctactatttttcctagatatattaatttatttgaaaaactagtggcatcactaatgactagtactttatgttatttaaagtattttcatatacatgattatttggttctcatacaaaccaaatgttgcatttggatacatgagttcccattttacagatgaggaaactgaatgagaatctgacctgttcatagtcatacagcaacttttgactcagatcttctgatcattaatcctatgatttctcaaacttcagcagtcatcattaactccaagtcaggtcaatgaatcttccactagttagttccactggcaaactcgatatagagaaatttcagtttgtagaaagtcaatgaatatgaatttaagaaacaaatttaataaaggtgttaacatgtaattataaaagggaaaagaaatcttctaaccaactataaacctggtctcaagctcacttgggacaaagacatactaacctcgtcatactgattacttctgaggagggagggaaaacaaaagagatacaggctttagtttgatcgtaatgtattgtgtgcgttatgtgcatgtgttggggacctgagagaggccactgaatgggtgtctggcacattgtttacatagatgggctaatgggtgattgtggttttgggaatgcagagaaggacaaccttttattttgcttccaaatccaatcgagtcctacagggcagacccacatatagtgaccaaaatcagcttcatttctttttttaaaaattttattattattatacttctttaagtaagttttagggtacatgtgcacaacgtgcaggcttgttacatatgtatacatgtgccatgttggtgtgctgcacccattaactcaccatttagcattaggtatatctcctaatgctatccctccccactccccccaccccacaacagtccccagagtgtgatgttccccttcctgtgtccatgtgttctcattgttcagttcccacctaatcagcttcatttctgacaaggtttgggtaggtacacaagcctgaaatgtgcagccacaatggcctttctaacgtctacctcttaattagacagatttgcttggccaagtgcaggcgtatttgaacaatcacaggttcccacacaggggccaactggcccctgcaggattaagcaaggaagggcagaaaacacaagcaaatgcctattaaaatataaagacgctaaaaggcggtagattgaacatgttcagttctttctccagacccgccaatcagataagtgatgccttctctccccaggagacactggaagtgttcccatactttccttttctgaggagcagactttaacatttgttccatggagacagggagaaatggtagaggtaaagtgtgtctcactgacattaatcaagatctgaagacaggtaaatagtatcccttacaggtggctccccctagcttagtactatttgaaggtgcctcacttcatttgggaggcatggtgacatgtcttttttgacagctcataaactatttgttcttttccttttctttgaccaagtccaagataaatgcgacaatattaaaccttgccctcttcccagtttgcttacatgaaatagtctgtgttttcctttcatcactcttactacacatggtaaataataatacagacttcaagcagtggaaggaaatattgctttcatatttatacatactatttttttcaatacatgtacatatccctctggcaatatgacaaaatgtcagggatggctatcattatcctaggaacctgacagtaaaagccatgaggggatctccttggtctcctggactcagttcttctggcttagccacaggccacacctttcatatgctattcagagtgtttagccacatgagtggctgttaatgacatggctctcaggtaaaaaggataactgagaattctaccaaatgaacttcctttgaccaaatgacaccaattataccttttcaacattcaattaagaaacatgacattctcaatttgatgttgccaacaatcattcagaatttagagaaacctccagagtcacataaaggtaattaacctaacatttactgagtaacccttaggtgccaggaatcatagataaaagggggaataacaggctcctacatttaaggaactcagagtctagatagagaactgtgaaagtgagtaattatgatacagaatgggagatgaggaaaggaaattaagtttgtgcaagaagtaaagtgccttctatgctgcaccagaagtttagacttgatcctttggccagaggctgttaagtataaaaatgactattcagatctgttttttggaactctatctctcaggttgtggaggaccattaacagaggagagaggacagagcaccatctggaggaaagatgataggagcccaaacacaggcagtgaaaagatgaaattatcacttctcttcttttaaaatcctgttataggaaacattaagttcagtactggagattataagtgtcgtgaagaaatgatgtaaggagctaaccagaaattattttgtcaaaattcttctcccagaatatcttgcatatgaagccagaaccaatttcaacctgccatagaattagaggtttttgtaattttaacagatcatggtggttgctgaaaatatcagtggaattttaaagtatatttacatttaaaatgacttaaaacaccagaaatgatagtaaatcttcatacattcaacaggaaactaattccaataagtctgggaaggcagtttaacacaccagcattgcttatggttatcttcaatccaaaaattcttatatttagctttgtattataatttatacatacaagtctgattagcccattagactctaagctcctttcctgagggcttaattttttgtacccctcctcgcaaactgcctgtcacaaggactagctttatgtagagaatcaatattcatattttcaacaattttttttactgagtaccaatcatgtgccagatacaaggaacccattagtgctggagaaaactctgtgaacaacatataataacccccgttttcactgagctgacagtccacaggggacatgggaaatttccataccgtgttaggcagcttactccaggggaggaatggaggatgccagggatgcccatggcataacacataacttaagggacaaagaaaccttctcaaagaaggaagattcaaaggccagtaggagttaacaagatgaggagagagcaaagagttctccaggtggagggaatagcatctgcaaagaccaggaagacagaagagagcaaggtgcgtttgctcataggaaagaggttcctgatggctggggttcagacagccagatgagatgtagagtgggagggcatgataaaccaagcctggtcataaagtttcctgtgtaacttcagcacagggcctggcacaaagtgaacactcaaaattattgaataagtcaatgtacgtcagcctgcttaaacattttatctatctaccaaaattaatctatgaattcaatgcaatccaatggaaatctcaacatgattttccaaataatttggaaagataatctgaaaatttatacagaaaggaaaaggaagcatactagccaaaacaattacgaaggagaacaaggttgggggacatgtgatatctgaaatcaaaacttattgttgagccattataatttatgtttttatatttttttattatactttaagttctagggtacacgtgcacaacgtgcaggtttgttacatatgtatacatgtgccatgttggtgtgctgcacccattaactcatcatctacattaggtacatctcctaatgctatccccctggccccacccaccctacaacaggccctggtgtgtgatgttccccttcctgtgtccaagtgttctcattgttcgattcccacctatgagtgagaacatgaggtgtttggtttttagtccttgcgatagtttgctgagaatgatggtttccagcttcatccatgtccctacaaaggaaatgaaatcaccattttttatggctgcatagtagtccatggtgtatatgtgtcacattttcttaatccagtctatcattgttgggcatttgggttggttccaagtctttgctattgtgaatagtgccgcaataaacatacgtgtgcatgtctttatagcagtatgatttataatcctttgggtatatacccagtaatgggatggctgggtcaaatggtatttctagttctagatccctgaggaatcgccacactgacttctacaatggttgaactagtgtacaatcccaccaacagtgtaaaagtgttcctatttctccacatcctctccagcacctgttgttccctgactttttagtgattgccattctaactggtgtgagatggtatctcattgtggttttgatttgcatttctctgatggccagtgatgatgagcattttttcatgtgtcttttggctgcataaatgtcttatttgagaagtgtctgttcatatcctttgcccacttttggatgggattgttttatttcttgtaaatttgtttgagttctttgtagattctgaatattagccctttgtcagatgagtagattgcaaaagttttctcccattctgtaggttgcctgttcactctgatggtagtttcttttgctgtgcagaagctctttagtttaattagatcccatttgtcaattttggcttttgttgccattgcttttggtgttttagacaggaagtccttgcccatgcctatgtcctaaatggtattgcctaggttttctcctaaggtttttatggttttaggtctaacatttaagtctttaatccttcttgaattaatttttgtataaggtataaggaagggatccagtttcagctttctacatatggctagccagttttcccagcaccatttgttgaatagggaatcctctccccatttcttgtttttctcaggtttgtcaaagaccagatagttgtagacgtgtggtattatttctgagggttctgttctgttccattggtctatacctctattttggtaccagtaccatgctgtttttgttactgtagccttgtaacatagtttgaagtcaggtagcgtgatgcccccagctttgttttttggcttagcattctcctggcaatgcgggctcttctttggttccatatgaactttaaaatagtttttttccaattctgtgaacaaagtcattggtagcttgatgaggatggcattgaatctataaattaccttgggcagtgtggccattttcacgatattgattcttcctacccatgagcatggaatgttcttccatttgtttgtatcctcttttatttcgttgagcagtagtttgtagttttccttgaagaggtccttcacatcccttgtaagttgaattcctaggtattttattctctttgaagcaattgtgaatgggagttcactcatgatttggcattctgtttgtctgttattggtgtataagaatgcttgtgatttttgcacattgattttgtatcctgagactttgctgaagttgcttatctcttaaggagattttgcgctgagtcgatggggttttctaaatatacaatcatgtcatctgcaaacagggacaatttgacttcctcttttcctaattgaatgtcctttatttccttctcctgcctgattgccctggccagaacttccagcactaggttgaataggagtggtgagagagggcatccctgtcttgtgccagttttcaaagggaatgcttccagtttttgccctttcagtatgatattggctgtgggtttgtcataagtagctcttattattttgagatacatcccatcaatacctaacttattgagagtttttagcatgaagggttgttgaattttgtcaaaggccttttctgcatctattgagataatcatgtggtttttgtcattggttctgtttatatgctggattacgtttattgattttggtatgttgaaccagccttgcatcccagggatgaagcccacttgatcatagtggataagctttttgatgtcctgctggattcggtttgccagtattttattgaggatttttgcatcgatattcatcagggatattggtctaaaattctctttttttgttgtgtctctgccaggctttggtatcaggatgatgctggcctcataaaatgagttagggaggactccctctttttctattgattggaataatttcagaaggaatggtaccagctcctccttgtacctctggtagaattcggctgtgaatccgtctggtcctggacttttttggtcggtaagctattaattattgcctcaatttcggagcctgttattggtctaatcagagattcaacttcttcttggtttagtcttgggagggtgtatgtgtcgaggaatttatccatttcctctagattttctagtttatttgcgtagagatgtttatagtattctctgacagtagtttgtatttctgtgggatcagtggtgatatcccctttgtcattttttattgtgtctatttgattcttctctcttttcttctttatttgtcttgctagtggtctataaattttgttgatcttttcaaaaaaccagctcctggattcattgattttttgaagggttttttggtgtctctatttccttcagttctgctctgatcttagttatttcttgccttctgctagcttttgaatgtgtttgctcttgcttctctagttcttttaattgtgatgttagggtgtcaattttagatctttcttgctttctcttgtgggcacttagtgctgtaaatttcccgctacacactgctctaaatatgttccagagattctggtatgttgtgtctttgtttttgttggtttcaaagaacatctttatttctgccttcattttgttatgtacccagtagtcattcaggagaagattgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcgattttggaataagtgcagtgtggtgctaagaagaatgtatattctgttgatttggggtggagagttctgtagatgtctgttaggtccacttggtgcagagctgagttcaattcctggatatccttgttaactttctgtcttgttgatctgtctaatgttgacagtggggtgttaaagtctcccattattattgtgtgggagtctaagtctctttgtaggtctctaaggacttgctttatgaaccttggtgctcctgtattgggtgcatatatatttaggatagttagctcttcttgttgaattgatccctttaccattatgtaatggccttctttgtctcttttgatctttgttggtttaaagtcccttttatcagagactaggattgcaacccctgcctttttttgttttccatttgcttggtagatcttcctccatcctttattttgagactatgtgtgtctctgcatgtgagataggtttcctgaatagagcacactgatggatcttgactctttatccaatttgccagtatgtgtcttttaattggagcatttagcccatttgaatttaaggttagtattgttatgtgtgaatttgatcctgtcattatgatgttagctggttattttgctcgttagttgatgcagtttcttcctagccttgatggtctttacaatttggcatgtttttgcagtggctggtactggttgttcctttccacgtttagtacttccttcaggagctcttttagggcaggcctggtggtgacaaaatcactcagcatttgcttgtctgtaaagtattttatttctccttcacttgtgaaacttagtttggctggatatgaaattctgggttgaaacttcttttctttaagaatgttgactattgttccccactctcttctggcttgtagagtttctgctgagagatcctctgttagtctgatgggcttccctttgtgggtaacccgacctttctctctggctgcccttaacattttttccttcatttcaactttggtgaatctgacaattatgtgtcttggagttgctcttctcaaggagtatctttgtggcattctctgtatttcctgaattttaatgttggcctgccttgctaggttggggaagttctcctggataatatcctgcagagtgttttccaacttggttccattctcgccatcacttgcaggtacaccaatcagacgtagatttggtcttttcacatagtcccatatttcttggaggctatgttcatttctttttattcttttttctctaaacttctcttctcatttcatttcatttatttgatcttccttcactgataccctttcttccagttgattgaatcggctactgaagcttgtgctttcatcacatagttctcgtgccatggttttcagctccatcaagtcctttaaggacttctctgcattggttattctagttacccattcgtctaatcttttttcaaggtttttaacttatttgccatgggttcgaacttcctcctttagctcggggaagtttgatagtctgaagccttcttctctcaactcgtcaaagtcattctttgtccagctttgttccgttgctggtaaggagctgcgttcctttggaggaggagaggcgctctgatttttagagtttccggtttttctgctctgttttttccccatctttgtggttttatctacctttggtctttgatgatggtgacatacagatggggttttggtgtggatgtcctttctgtttgttagttttccttctaacagtcaggaccctcagctgcaggtctgttggagtttactggaggtccactccagaccctgtttgcctgggtatcagcagcagaggctgcagaacagtgaatattgctgaacagctaatgttgctggctgatcgttcctctggaagtttcatctcagaggggtacccagctgtgtgatgtgtcagtctgcccctacttgggggtgcctcccagttaggctactcaggggtcagtgacccacttgaggaggcagtctgtccgttctcagatctcaaactccgtgctgggagaaccactactctcttcaaagctgtcaaacagggacatttaagtctgcagaggtttctgctgccttttgtttggctatgccctgcccccagaggtggagtctacagaggcccacaggcctccttgagctgtggtgggctccacccagtttgagcttccctgctgctttgtttacctactcaagcctcagcaatggtgggcacccctcgcccagcctcgctgccgccttgcagttcaatctcaggctgctgtgctagcaatgagcgaggctccatgggcgttggaccctctcagtcaagtgcaggatatagtctcctggtgtgctgtttgctaagaccattggaaaagcacagtattagggtgggagtgaccggattttccaggtgctttctgtcaccgctttgcttggctaggaaagggaactccctgaccccttgcgcttcccgggtgaagcaatgcctcgccctgcttcagctcacactcggtgcactgcatccactgtcctgcccccactgttcaatgagccccagtgagatgaactcggtacctcagctggaaatgcagaaatcacccatcttctgtgtcactcactcttggagctgtagactggagctgttcctattcggccatcttggaaccgcaccctgagccattataattttaacagcgtggtttcagtacaaggatagacagatcaactgaacaaaatagaaaatcccaacgcagaagtatgcttgtatgtggacatagcatttgacaaaacctgctttgcagatcagaagaaaggatattctaataaatttttaagactattgattttctagaaagaaacaaaaatggaactttatctcttaccataaacacaaaatcaattatacatgaattaaaaaccaaaacatgaaaaacaaaactttaaatcttttattaggaaagtgtagttgaatatatttatgaattagggctagagaggaatttcttaacacaccaaaataacacaaactcaaaggaaaaaaatgataaatttgaccgcgttgaatttgataattctgggcttcaaaagcatcactagaaagatgaaaatgtaagcaacatatctgacaaataattagtgtccagaacataaaaagaactcttacaaatcaacaacaacaaaatatatagaaaaataatgggagacagagagggaaagaaggaaagtgagagggagaactagagggaaggagagaggggaaatgacaagaatagaaattctaaatagaaaataagcattttaaaatgctaacttcgttcatcggggatgtgtgaattgaaaacctcaatgagatagcactttatacccattagactggcagtaatttagaattgctataggtaatataaagtcttacagccactttggaggacaatttgacagtaaaaagcaaacttcttaatatgagtatttcatagcccagcaatttggtcactgcctaagtgcctcaagagaacctatcccacatgaacaagtttgtggatgaagcattgtttgtcatagaaagaatagaatatataaattgtggtttagtcatacagtggaattcagcacttcttaatttttaatttctgtgggtacatagtaggtgtatatatttatgaggtacatgagatgttttgatacagacatacaaggtgaaacacgaacatcatggagaatgggacataccctcaagcatttatcatttgagtgacaaacaatccaatcatattgttaaagttatttgaaactgtacagttaagttattatcgactatagtcaccctgctgtgctatcaaatagtaggtcttacttattctattttttgtgctcattaaccatcctcaactccccaccactgcctcccactacacttcccagcctctggtaaccatccttctactctctatgagttcaattgttttgattcttagatctcacaaatcagcgagaacatgtgatgcttatctttctgtgcctggtttatttaacttaaaatacagcaggtgaatggatttaatactcacaggtatcaaattggataactctcaaaaatatattattgaacaaagtttcagaatcatacaataaggtgtttgttttaaagtatgcaaaattattgtattttattgatgctatttagaagtacttacatacataattacattttttaaatattcattgaatggataaactctaaattcacaattgtggttactcttatccagggtacagagaggggagatttgatgtggggggtacaaagacagcttctactataaatttattattttgttgtcaagctgtggtacacagatgtttgttatattattcttatacctttctatatgcctcaaataccttgttacttttgtttaagaacctggataagcttgattcaggtattcttctgtttgaagcataggttacttaaccataattattcatattttatataagaaggaatttcacatttcttgttttcttttgcctttttagtagcattattttaaggagacaaagctgagacttagattaagtgtctttcctgagccaacttaattgaatgacagaaccaagactgaaaccagctggttggccctcacatgacttcctccagcccggctgccactcagtgtcagggaaaaaatcggtgccatggagacggtctgaaatggcttgattgaagggagaaaggggctccaaattgctccaaatagcactctccagacaacggcacagaaagcctgtttccacagctgatgctgagggtcagtgggatgagattgcatgccgcccaatcaagcgactgcagaaatgcattgataagggggcaggagcctgatcagcctccctcttttcacatttcaaggcactaattgtaactgtccttgccactagtgcaatgttccaaatccccactcagagcatgattaaagattggtctttctaggtgtaaaatattgtgtctgttggacaatagcatcctataaaaacaaattaggctatcttgatagtaattcaggtgcaagacgtgaaatgaacctggcattaggcagaaagacacaataattgttttaaactggaattaacttacgcacatctggaaagcagcccttttttccagcccaagcactttccacaggcaaactggcttccctcacaggcaggtccagaacacaaagaaatggaaaaccaccaccgtcatggaaaactatgaatgtgcgtcggaaaggcctgtccatttttgtttggcaaagaaacatgcaaaaaaaatcaactgatgatacactaaaattcttctttgctgatacattttcacaactattaggcttgtggaattagtcactatagtacattcagctggttcaaataaattcctgaaagaaattacctatttgtttataaagtactttataatgaattactaacaagcttcagttccatgcatacatggtttattaacaaattgagttcgtccttcatgaacacagtcaacatggctatacccgactgtcctaccatattgaatgaatgaatgcgtcagcttcattgccgatgaagaagtgcagtcaagctgtggctcacttttcttatttgatttctctgagtttctttagtcaccaaccttctattgtgagtaaaaatgagtgtagccagaatgttttacattaaacactatttttattgaaaactaaactatttcttcattgtttctaaatgtaattggaatctcaacccactctatcacttcaaatacaatcaatatgttgggcctctccctgaactgcagacttggtatccagctgcttcctagcatctccactaagatgtgcaattggtgtctcaaccttactatttccaaaacagatctgcccactcttaccccaaaactgcttctttagtgatcttcaccctagtagtaatgacagccttaacctttcattgcttaggccaaacttcagagctaccctagactccttttttccctcacatcacagccacgtatccttatatccagtgtatcaggaaatcctctcatatctattttcaaaacacatcaagaaaatgatcacatctcagcacattcaacactgtgaccctgttttaatccaccataacccctggctgggattattttagtctcaaaacttctgtctctccttctgtcttgctcccctttagtttgttctcaacacagcaaagtggttattaaaaaaaaaaaaaactaagacagatccagaactcctctgctcacaatcctttaataatttttcatcccattcagcacacaaacagatctggaccctcaatacctacttaacctcatctatttccgtttgtccttttgccagcatccttgaataaatccatgaataaaggaagaaaggagtcatgtgctgtatttttgggtctcaaagtcagcatggtcctgttggaagagcacagcttctggtttaaaatctagctcagtcacttcatagtttatttagccaaattatttaatttcttgatttcttcatttgtaaaatggaaataatgcataaaatgattataaaataaaatatatagattgcttgccatacattttgtgatcaacggagctgcttttattagtgcccgttttaatgaaaaaattcttgtttatcatagcatggttctaaggcatatatagtgcaataactacttgaaaatctttaaacagcagcagggaaactgttgaacatttcactcctcataaagctcttgggttttgggatacaatacactttgttagttcactgatttctttattctttattggaaagcatttattgaacacatactgtgtagcaggcacaggagatatggtagcgaataaaatagacaaaaactcctggtctcacaaagcttgaatgttagtgcaaagcaacagaaaataaataagataaatgagaaaaatacatagtatttgtagataagtgccaagtgaaaaatacatagcaagcaagggggagataaagaattgggggggaatttttggataggggagtgaggaatgaccacatcttctacctctcagatcatttctgggtccctttggtgactcctcttctccttcttcctggatcttaaacatcagcagccctcttctcctgttccctgaactctcagtgggtgatttcaggctatactttgatggcttcatttatttcttataagtgataagctcccaaatcttcacctgaccagggcagactcccactccctttgctcctgaatctgtctatatggacatcaaaagtccatgtgtctggaatgaactccttcctccactccctttggccaagtctcttcctgactctgccccattagtgggacaccgtcatccacaaggcctctgaagattgatacctcagtgtactttgactcctcgctctgcctctccagccttggagaatcagacatacagcctgtcagactcgtgttcataaaaattcctcaaatccttctcctcctttcatcatttctcatgtccactaactcaatatgaaactgccctctaaaaacatttttctctcttctcccctctccaacccctccttccattctgcagctagatggatttcttaaaagtggagctttgatgatatctctcatctatcccaagatctcctcctttggcccttaacataattcctaatcctggcaataaacaccctctacagtctgacacgaatctttttttccatcttgatctcaccagtgcacactcctacccactgcttagactcctcctgttgtcgtccctgctgcatgtatcattcattccagcctgagcttctgctcacaattgctcccactagaaaagccctcacccctgcctttagtctatccaaaatccactcatcattttagccactgatcctcaaggtaaggtgtatgcactacaggaactgcacgagataatccatttaggggcagaagtagattagaaaattctatttttgtttattttttttactgagctttacgaatatgtaatatgcaaactgatgctgacatgaataccagtgtgtgaaatgcctttctcaggtggcgtatcagccagcaggtattctgaaggtgagaagacgttccccagaacaatgagtattgggctactctcaccccttcatggttccagcacactgtggcaaattttactctaaagtgctggttaagtgttttatggattatattatcagaaaaaatattattatactgagacgagcaataatcacaaactctttttgtcagacaaaagtttggtaaaaagagttggcaaacttaaagctgagttggcagttttttctttcaagaaagataagtgtttccaaatctctggccttttctgtgaggaaaaatgactactgggaccctgctacccagtacatattttaagatataaatacatgccttcaaaataaggtgatatttggatcatggatgaaaaattaactgttttttcaaaaaaattttgtgataaagcattttaagaaagtaagtgtagaaatgctttcattgttaaggtgttattactgatatgatgtgtgtcacctattaaaatgcccaagctatatgcttaaataacttggaattaaattttctaatctgcttaaaaattttcttaaaaactatttttcattgtttttaaaatctgtgtgtatgtgtgtacataatatatatatatagtatatatctacctatttctttatgtatttatattgacagtacaccctaaaaccttcttaatggtttccaaaaccaactgattaacattcagtgaagctacatattcagggaaaggaaactaatatttttaaaagacagaaaaaacagctttagcataactagtggaagagattttaaaaagacttagtaagtgtagctatcaatgcactttttccatttggaactatgcagatttaagcaaatattcaatggggtattattgataataacacaaaaggagaattaacctaaatatccatcactatggaaatggcaaaaaatatggtctattcatataatgtaattgtatacaactgcaaaaatgagaaaccagagctacatgcaataatataattttcaaaaacatttttgggcaaaaaaagaagaaataagttgcagacggatatataaaggttgagactatttgtcattttggaacatatgaaacaatatcaaatcttgagtttattgttttaaatacatccatatgtaataaaaataaaaacacacctatgaaagtgagacacagtgaatttagaaaatgattgcatttggaagagaggaggaagaatggggtttggggaggccattgaaaggattttaatggttatttttatgtttgattacttacactggatggtggctacataggtttttattttattatcttcttgtgcacctgaattatttcataataaaatatatttttcactattgaatatgtttttttaaatccctttgaagaaattacaacaatggaaaactcgtagacttatgtccatggcaaaaacattctgagatgctctattaattttagaaagctggcatggagtgactgtggatttctgaaagtgtgtgctgtgtttttctactcattaaggacactttctcagagtgttaaacataaaatactgaatggctgaacaacctagagagatataatctctagaatctaaaagcagatagaaatgtaggggtcagaggtggaagcaggtcagtactgtattctcatctttagactttaggcatctttccatattcctccaacaatttctagtatgaaaatatctttctatgcataagaaaatcaaacaaaaatgcattaagaaagataaaataatttattctcattaaattgtgtcaaggatgatttcaaattagatttttcctagagacccaaataaaaattaggtagaaaatttacacgtcaaagccaaaataatatttacatgtatttaacttgaggaaatatttcttaatttatttaatagatgacttccatttaagaaaccaagctctataatactaataatgtatgtcttagaactcaaacaaagcaatagttaataaaacaaagcattaccaacttaccagaggtggtccaagtttaaaggcttataactgaatctccaaccaaatgatcaggttaaaaaaaaattttaacatagatttaaagtatattgaagtagccaagttagtcccttttaaataaaagagaagaagcaattaaagaaagctttaggatatgttgttaaggagaagatttgtggtcagaagaatccaactacaggcttgatttggccaagtcattataactttttatagctttactttactcatttgtgaaatgaaaataagattacttcgaggatctagtgaaagaagaaaatatgtgacttcattattatatactagtacttgattttttaaaaaagccagcttactctaaatgtctaaaagattccaatgtaagaatttcacaagatcccaacaagaactcattgtaattttacaaactgctgcactcatttccaaattatttaggataaagattgcagaagattcactttcaatacataaaaacttttaaaaaaaattatttttgtggtaaacaacagtgcatttccattaatggctccccttttctttttttaaagtaaaattatgaaagcattgaatgtttcaggtttaaggaaattataaaaatgtgttaataatatgagtcttaagattgtacaaaacaatatcttgagcactagctgttgggggttaggaggagggtagtggatatttactctctgtaaagacagacagcaggccctcaaggcattatcagtcatgaagaaaaaaaaaatatatatatatatatgtatgtatgcatgtacgtggaactgaaagcccttgggatccagggccaccacgtatagtcgtacaactggggcacagcacaaccctccatggcaaagttcacagagaccatgacagggtgagtacagagttattcacttgtattgggttccagacactatgctattgccagcatataaataccaggaagacacaatctccctcatcaaataaaaaaaaaaaaaaaaaaactcccagctcagtggagaaggcagaaacataaacaggtaaaattataacaaggtgagaatgcaaagacggaggtaggcacagaagatagaacctgacactgcatggagaaagagactcagctaaggatttatgaggaggtgaagcctgagttggacccaaaagtgtgagtagcagctaatggagaaaaggcaggaccggagcttcccgggcagatgagcagcaatgactaaggtactgacaagaaacggcctagcgtatccataaagctgtgagcagtcttgggggtacaggaccctacaaagcaaggtattggggaacaaatatgtgactgctcaaaaagccagatctgacttgtgtgaagtctagcattacacgcgcagatatgaccatctgctttggaagagcccaaatctataaagttctgccttccatatgtaccctacaagattaaactacagcctgatgacctgcatacaatcatttttgtcttctagtgtgcattccattagacacatttgttctactgattgctttctttgtctctgtttacctgtatttccccgcatcaagtgccactgacaactttcaactaattctccatcctaatgaattagaactagggcctccttatgttttaaaacatgccatcaatctacaacttatttttttcatctaaaataatatttgtgtttacgtaattacagaaattattacatcatacagaagtgatttcatcataatttggtttaccaatttgctgtcattagacattttggttatttcaatatttactaccatgggtaatactgagatgacaaaccttatatgaactgtgattttaaacccatgtgatgtaacgtctgtaattttctaagaataaatttatagaagtgtaaatgtcaagtcaaagagagcatattaaaataaaatcttttgaaaatattgccaacttgctttctgtaaaagttattcccatttactatcctgtgaggagagtgcctgtttccccaccttcttagttattttcagtccataatgctgagctgaatctacaaagtgacctcatgtcttccttggacatgtatagtcagcatacagagatggttaatggataaatactcttatcctgatcagaagaaataaatgcaagtattgaacaggtaagccagttgtagaaattctacagtagcaagccaagtagtcagaggcaaaatccttctactgctgtttttcctggattactatttgttccatgcaaataacaggtataatgtctttggctcacattttaaaatcagaagaaaaaatctggatttatggcttctttagaaatattggaacatctggaaacactatgcacgaaaggtactactgactggagctgagaggggttgcccctttagacagggagttacctccaggtgatcatatgtttcacccaggtgccttcactcatttgtattacctgcctggccattgtcagcatttgagttcgacagtttgaatactccaagtactgcttcttcgctggaataacagtaaaattatactggagcagaattgtaacacaaatttatatatagtgaaaatcaaaccttaacctctgaaatataacagtatgttgtgcccctgagttggtgagtcatatccagttctacattataaagatattttaccataatatgtttacatatatctatacataattcatgtgtgaaatacgcatagccaaaaataatataattgctagtctattattagaaatatgtgcaacaatagattgcaaatattaaaatacaaggattttgttcacatgtactttccaatttaattcaacctcaaactgcaataagcttacttggaaaaataatagccaattaaaaattttaaatatctagcctgtgatcagaggacaaaaatatattcatttcattaagttcaaaagtgtaattagacatatatctgtgcatggtgtcagaattctgcaggcagttagttatgcaagaccaaatagaaattaaagcctgtgaaataggtgttatgaagttttttcaattgcaacaaaaatacagtcatgcagaataaagatggcaaagccctcaggagaaaatggaacaaatgatagagtataaacacatacctttgtcagaagaaatgggcctaaggttgtattttagtaaatcttagttaaacatatcaagaggatttatgctaaggtttgcaagtaatagagttcttgtaaagcatagggcgtgtgtctcaagatgtcctatataaagtgatttacatgacaagtaagaaagagaaggtttccaaggtttgttttatttaaatgacttgcaagataaaaataaatgctttcttcaccaaggcatctattgctctatgaatatgcatgtacagtagcaatagattagatgaataaagaatttagaagcctgtctactgtggttaacataaaacagcactgtgggccaggcacagtggcttacacctgtaatcccagcactttaggaggcggaggcgggcagatcacatggtcaagagattgagaccatcctggccaacatggtgaaactgtgtctctattaaaaatacaaaaattagccgggcgtggtggcgcaagcctgtagtcccagctgcacgggaagctgaggcaggagaatcccttgaacctgggaggcggagcttgcagtgagccaagatcctgccactgcactccagcccggcgacagagcgagactctgtctcaaaagacaaaaacaaaacaaaacaaaaaccactgtgtctgctatatcagttttctatatcttaatacccactttagtttttatttatcaaagagaatttcaaacatacgcaaaaataggccgagtaataaaggaacttccatatacccattatctggcctcaacaactatcacatattggccagtactcctatatccatactctcaaccaccttcaccccttctgtattaacttgaagcaaatctcagatatcataatatttcatccatacatgttacagaatgtatccctaaaaaataaaataaaatctatttttcttaaacataaccatactcccattatcacactggaaaaaactaatttctcaatattttcagatatcctgttagtgttcaaacttccagttgtcttataaatgttatagttttaatagcttgtttttaaaaatcaagtttcaaataaggtacattataattgttactttttcatttatgttgcattaatgggatagattcctcctccatcatcttttctttttcttgaagtttatttcttaaagaatattgggttttaaattatttaaaccgattggaaataaagttcaaagtaggtttttgtcttttaaaaagtaagtatctgattaaaatagggaaagaggaatcgatgtctgatagtgtatgtctgtaaatgtgtatataagtgtgtgcgtgtgtgtgtgtgatatagtatcacttttaggaacatttagcaacagtgtgattactcgttcatgcatgcattcatttatttacgcatccatccatctatccatcccgtcatccacccatccattcactaacactttgagaactctacttgccagtaatcctccaaccagtagggcctaccaagtaaaataagacactgatctctgccctctagttgcttgcgcacttaggagtcagatctagaaacaaacacaatgtaacacacactccaattattcctacagctcaatcacacaggaaagaaagaattgcctcctcaaattcagaactgcatttctgaatcagcttaattgctgaatcccccaataatctgagtcaacacaggcattctaggccttggtgattatttccagcccccactcagcatttcctgatgcagaaatatcagcatcctcttattacaaaacttttgattcctgaaggcacagatcctggtctcagtgtgcacctgcatacatgatcaccctcatcaattaactcttatgttcgtcaaggattcattgaaatccggttcactatgcaccacgtagaaatgtccagctgccacatgaggtgggcatgggttggcatgtacttgtccatgctcttggcagatattctgccatcctcttaggacaaaagactggtttcacagtgagtgcttatttcttcattaaaaaatgaaaagtctcttctctctcccttggtctatcctagaactgtgtgtaatccttttctacagctcacacctaattttgatgcattcttatcaagccaagaatgccttgtagccaagtcccctctcaaacttgctcagacttcatcttgcccagattcctgtattgctccaatcaagggaatctgcagtcagtgaaaattctttcttcagcctctgcttaaacattcaaacctatctcagtagatccaaagacctgcagcattgtcctccagaagccctataaattgctgccttccttgagcattttaccccatagacatataagccaggcttctgtaagggatagtaggagtctggaataagcctccgaaacacgtgatgttagggattgtgtaaataagagactactgtgcccaagaaaattgttaagtctcagatgacccaaagaggaaagggcagatgtgagcagtgaagagacgtgcagaatccagggaagctcagtaagctcattagccattctgcacagagctattcctcctttcacagtctgtatcaattacaactcctgcatgcccctccttcagagcatttccagaatctgagcactcctcatgacccctactgtacaccccacccctagccaccatcatatctcctgtagatgagtgacatggcctcctggctggtctccctgcttccataccagaaaccttcccacctccaggcctttgcatgtgcagtttcttttctctactgggaagttcttccccttggaacttcccaaggaaattgcatcctcggtgttcactccccatcttcttcaggtgcatgttcaaatgtcacattattagtgaaactttccctgaccccctacttaaaattataacacgcatacagtaataccagttgttccaatgccatttccttagtttatttttctccaatttctaatacacgatatttctcatttgtttctcattccctcactagaatgtgagttgtacaaggacaaagattttgtcgattttgttcactgctgtacctttagtgcctaaaacagaacctagcacatatgtgtttcataaatatttgctgaatgaatgaatgaatgagtgaattctcccaaaatattagggagccctttgtgtgacaccaagttagacataactgttacccttgaggtgctgaagcacacaatacttgaatggtcatagcaaacacatatctaatatagttattgaactcaattggaaatgctagtgtgtgggaaggttcttggtgcattgagagagcaccattcagctaaaattcttaatgtgctaagggtgcccagacacagcgtgatgaggagaagatgctggagagaaaggctgcatcattatataccatttgcattttcctttgatttaaaatattcatggactgaagtagatctaggacctcagggcagcaacagtcattaaagtcagtccagatttcctaatgggcaggccgagggggaggcagaacaattggacagcctggacaggctagtgagttgactctccttaaatgcttattttacacatattcattcaccattcatttaataagcacatggaaaaaatgttctattaataaaattgcaaactttttgtttgaattcaatgtgaggtatttatttaattccttgtagtaacaccatattttaatgtatttggaatccttcacttcacagtttttctgtcactcataactagagttagtcataaaactcactgaaaacaaacttcacttacattagtatgttcaatatatttgtcttttcttctgtccttcatgttggcaaaatacttcccacttttctctctttgatgtttacatgtttttcctcaaatgacacaaccttttattttattttattgagacagagttttgctttattgcccaggctgaattgcctgatggctcactgcagccttgacctcctgggctcaagcgatcatcccacctcagcctcacaagtagctgggactataggggtgcaccactgtgcccggctaatttttttattttttgtagagacaggtttcagtctatgttgcccaggctggtctcgaactctgggctcaagtgatcctcccacctcagcctcctaaagtgttgggattacaggaatgagccaccatacctggcctgagataacttattgaactatgtattaaagggtttaaagttgagtgggtagcataaatcatttgttcctaggtctttatttggtttctgcttctgctgactccaacgctgacttgtgcccatcaaatgataggttataaaattagagatgcaggcctaggtctctaacatgcacaggagatataggttcctgcggaaggaaagtagctcctgtttgtttttgttgttgttttttaatagagttattcaactgatgctggaccagtcaacatcttgccatatctgaaggtgaagcttgtggcaatctgcattagctggcactacagtcaatcaccttgtggagaaaagtggacattctgcagcctggtctctttccctgctgacactgctgcaagcactgctgctcagtgtagactggtggtccaggaccatctgatactgtcccgcctagtgtttgtcagggcagaaaagggaacaaaaggtcgcttttccagtcttaaactatcttaatcatctcatgtcaccatgcttctgggtcccacctattatgacatacacacagtcatatcttcctagtgctaggtttctagttctgcctggaaaatgtggtcacaaccagccctttggttcagatgccctcatccttagggaaaattccctttcacaactttctgagatgttctcttgacagttgatctctgtcagggccatcttcatgtaagacaaatgatcaacctcataacagtgtatcaaaatcttaatccttctccttcaaaaggatcccttatactcatgcaaatatcccctgttctcttctcatcaaagttttattttcacaaccaaggagaatggaaaaacagggcctctgtcaggacaacaaatgtgtagttattcccttcccaagaaagcaacacttgctttatatatccagagctaagagggaccactgaaaggattccttcagcagagaagatctctgcgccacggtgacactaagaaacaattgactaaacaacaaaactctcttagttgtaagcattgatggatttagaactggaaattcccactggattaaattgttcattactgcatgctctttggtgtacctattttataagactattagaagctttgttttttgacttaaggtgttatctattaataaagaatttttgatagaataagaagtgcttgagtttatatatggccaattgttgcccatcttaaatggatctgaaaatctattatgctaatttgcatttggagtagtttttttgtttgcaaattaagtgggttttaattgaggagggtaagtgatgtccaatgtgattaatcttattaaaaggataaatctttcatgcatgaagccttaatatttcagccgtgaggttagcagtgttatgttgcaaatcctcatttaaattgtttgccaaaggcttgaattaaaaacaatttataatataaagttagtgtggccaaaaagtgatgacagataacttttagtgaatttcaaaataattgttcatccaaaaaaatggtttccaagtcaaattttatatgtctattatagaaaatgcctaatgatgtgctaattacctccagtcttttattactttaaaaaatgttaaaattagttacagctagagaaggatctccaattcctttgttgcaatgaataatgcaaaggtttgtttaaattcatgcagtcctatttataaaagaacacctgggtaactttattttgagcttagaacaaaacataaaattgttgagaacaggatatttaaatgtactcatttacattcttaggcagagcagcagtggtaaaatagccttgctgagaatatataaatctggatcagtgaagctgtaacagccagtagccttccatgaagggaaaagaggagaatgacaccaccatcaagatgctactcctgatcccttcccttcgtgaaggaaaaagggccagctgctgcctcgctgctagtgatggagagagacccgctggcagtggcgactctacttgcactccattctttctctgcctctctcatgtagtcactcctggcttaattgtgtcgcttcctgcaccttcttctccccaccacacacatagcccagacctctctctcttgaaatctccccctcaaagtttcctcgccacgttttggagaacagttcgttttttgggccatatcagcctcagaatgccccataccctgagctgagtcaagcacaagggtttgggcagctgcctgcatccccgaaacataatggcaaaaggatggatcactgcagaaaaacatctgacacattttcacacacaactctgtaatctgcaaaatctaatttggttctgctaatttggttggcagaagaagaaagaaatgaaaagtagaacctgcaataaaaatcctcaccagaacactccaatctctgttaaataatttttttctatgtgcacatgacaatgtatacatttggggtagatcaccaacttgagaccagctacctgacagcctctgatgtcatccatcaaagtcaattaaaattcacacactgaatattgctgtttgccagtaataagtcttagataatatatatagataatgtatataataaccatatatatatacatttctgcagttattttagagtgtgatgccagacactattcaggcatgtgtgatggcaaaaccatagaagtaaagggatatctaaatgggtaaaaacagtggtaacttcagggcacataataaatccttcactgcatatatgctagttctattgatagaaaataacttcttcgcctagttaactaaacaaattttgaacaaatattgaaaaaatgttaagtcaaaggaaaaccaaattactagccaggggagagtcccaaggcataaattaaaagccaagttgcaagtcaggatgtggtatctgagctattcaaaaaactactcacctttgctggctcctacatgttcccttttttttatttttattttttaagttatggatacataatagtcatacatatttatggcttacatgtgatactttgatgcaagcatacaatgtgtaataatcaaatctgggtaactgggattcccaggagctcaaacatttattatgtctttgtattgggaacattccacatcttctcttctagctattttgaaatatagaataaattattgttaactatagtcactctattttgccatcaaacactagaatttactccttctgactgtatttttgtgcccattagccaacctctgttcacctccaccttcccaccttcccagcctctggtaaccaccattctattccctccttccatgagatcaactgttttagatcctacatatgagtgagagcatgaaatatttgtctttctgtgcctgacttgtttcacttaacataacgtcctccagttatatccatattgctgcaaatgacaagatttcattctctttgaggctgaatagtattctattctgaatatataccatgtttttaaaaatccactgatagacacttaggtcaattccatatcttggctatcgtgaagagtgctgcattaaacatggtaatgcagatacttcttcaatatactgatttcctttcttttgaataaatacccagcagtggggttgctggatcatatggtagttctattttcagttttttgaggaacctccatactgttttccatagtggctcttctagtttacattcccaccaacagggaagcactcatccacctactctcttggtcttccagtctggaagttgctcccagtcatctgatgacccagtatccttagatccttcccttcccagctctctcttcacaatacctggaccaatatcctcaagttcagtcctgaggaagagctgctgaaagagctcttgcttgcttgaccaccatatggcaccaacagccttctccctaccctcattcaaggttgagtgtcagcccctctttcccttccctatactccagcagatggctggccttttccttacttctataatttcttccactagcagcccttctgattcctggaaatatccatctcctttgctcattcaggctccctcttcaccatggtatgtactgagcagatttgctcttggatttcactttgaccttcgctctaccctgtgtccttggagtgctccacggaaataagagtaacgagttggcagaagatgttaacagacaacccatttcctgcactctcaaacacatccagcctgcacagaatctcctgctgccctttcatgtgtatgccctgacaaggaggccttattgtctctgtccctgtcccctgtaggcactgccctgctcagaatattatcaggttctgcttataaaatacacatgaccaggaggttgaaatccaaatgcaaagagtcaagagtacccttctgtgttgcccagtgatgatttttaatgtgatagcatcagccacatttctgcctataaaaatccccagaagtaaaactctcttctgacagttcactgccatcatccagagcctcatcacaattgaacctatctgtttgtttgtggacatatggcacttgcattcacctcaagagaccctaaaagatttcaaaactttatgataatggaggttggatattttttaattgataaaacctttatggaataattttaactgacactcatgagaatcagacactacttataatcacagattatcatttaaaatacagtgtgcagacatactaggggataaccatattaattactcactgcagccattcaaatgattcctagagatgtttcctgcattctccaacacctgggatgcctgtctgctttctccctgataatgtaagtccatcattccttgcaagactcaagtctcaccttttacaaggaatcctttccttccagtcccactatcaaacacttgcacagaggttgctttgtaactgttaatttctttttaagttaacgctatctcttttctcctttgttttcttcatgaaacttagtaagatagcttacatacaaaagaccaaactctctgcagaatacaagataccgtacctacaaaaactgatgggccagtgactaaatgatcaagaaaattaatctatcaattaatcaatcaatgcaaaagtatgtaagtctagaaacctgatccagaaagtcatgccctgagcttaagtttaccaaacagtattatccttgcctaagagcaaagattcagatttggagtaatgctatatgagttcaagctctgtttggctatttaaccaaacgttagataagttattttacaggtcttagaaattgtttgccccattttttaagcataataccaaaccaaagagagaattaatgagcaaaagcctcataaatgatgtaaatgttagaaattaccactattatttcaatgaaatgggggaaaatcaggcccaggaaaaatttgtgcagtaaactgggtcaatctggagattctgaagtatgcacttagaaacagaacatgtcaacaaaacagaagtattgtttttccttaatattcagcctgtttatattctctagcttattattttataattgatagcaaagctataaatggctttggggattgttgcatatctcatatgattgtcttgctgtggagtaacaatcaagtggaaatggaaaaattttttgtcaaagatttctttctgtaggcaagatgccgctttttttctaagtatcttttagctgttgagtattttataatcattgacataaatataaaaatggtaaacaatgtttattgtttgcatacaagtgagtctgaattggggccttttactgccagtcattcccaatgcaatctcaagaatgtaataggcaatcagatggtgatttatctgacccattaccgagaaagaaccaagaaaaatctaaacatcatttggttcactcatgtgtgcactgcaaatgcaaaacagtgaattatctgagctttgtcatgattttctatgctataagcatatttagtattcaaaaatttgtttttatctttatccttaattttttttgttcaattgcaggaaaaaatacagaaacaaagtaaatgtaatggagtttcataaaggaaaaaaatgtctaaaacacaaagcaacagatacaccagaaaaataatactctaggctttcttggggtgaggtgtgttgttccaatgtcatgaccaaattccagctacagtgcttacttcagtctacactgcctataggaaatgccccctgtggtctgaacaggataccagactttgttgatgacatcactagaactgatgggagggctctgctaagcagctgccatgtgcttacacttcaagtgaagatgaagcagagttgtgtattgagtgagctgtaagtcccaaaacaaactctaagtcacaaaaggtacttttaattatttatgagtatgaccaacaagtatgttataaaattaacttgaaaagacaatacaaagtgttacaccatataaaaaataagccacacattaactacattactagttagtttagtagttgattatgcctgtcttatggagtcacagtctactgggtaaaatgtacattttccaaataatggcacagatgagtatgcaaactacaaactgagagaagtggtgtaaaggaaaaagagcacatggcaaaggaagctgaccaaggctggtgggtcagaggaagtctgagttgagacttggggtgacagtaggtggggtcaaggcaaggggttggggaaggggacagggcacagcaggcgtgcaatctccccgtgagagaaaacagagggaagcaaaggaaggttgatgtagccagaacacataggtgaaggggagcaatggacaaagtgaggaaggcagtaggcaaaagcacaccatcccaaccctgcagggttggcagtgttcctagaaggtgttgcctctgagttttaattggaaaggtgctttaatacattattttgggtttttttctcacagcaaccaatgaggcttttttccattctaggtattaagggaagcttttcaaattcataactaatatgtggcagagaaataactcataacttagatggactgactccttcacaagccatctcactgctctgtctgcccccccacatctctgttctctgttctttaatacagaggcagtgagtggattgatttggtcatagttccaaggaaacatccaagactcttccttcaggtcagcaatggattcttaaccctgcagttctaatcacgtggttttcagtaagcatagtcaaggccaattaaaatgtatccctaattctggggttttatagctaaaagagaagaaagcagggaacttttaatttttaggatctaagtcaagaattggccagagaaggtacactggaatacttttttaaacaaaactttgtgattagcaatagtgctaagcctggacttggaaagtccaaccacagcttcatgtgaagaagctaaccctgcctccttgttattgcaaatggtttggtcatcttcattctttgcagatcacagtcaattgcaagttccatgggggtaaaagacaactggacaacaatctaaaatattgtttttaataatgtacattctgtttatttcatttactctatccttttaatacttgaccttttctagacatctctggattacagtagaattcaagcaagggtcagcctcttgccaagataaaattctctacttctactttttacccttttccaaatgaaagagctatatttattcataccaatagatgaactaggcaaatgtttatggtgttgatattgaagtagactgggtgaaggctggggtggatgagtggctttcgtaagacaatattgattgctatcgcagataaaacctgaaatctcaataaaatagagttttgactcaatagaagttaacttcttgctctcaaaatcctggtagtggcaggaggtggagctgatgattccatgcatcattcagagacccaggatgatggagcctctgccatcttcagtatgtgcttctcaagttgccttgggtgttaacatccaacaagcaggtggggaaagagagaaaacagaaggatgtgtgggtcctgtggccaggccccagagtggtgtatatgacttcctgacacgttccactgaccagaattcagaaacagtcacacctaactgtggtcacgtggtttcactgtaagccacaaaggagagggaaacagattgggaatgaagtagtcagtttctgtataagacggatttaggagaattctgctttcttttctaaaccttgtattcagtggataatttgggatatgaagaaaatgtaatccacagtttgacattacatccaagtttatgtatctatgaaggcttctctatttatccactccccaacccaaaatctgacaaacatttcgcagttctcccaattctccctttcgtaagaagtttagtaacaacacatcctttcagatacaagcagaagaaaaggcaatttctgtctgctgttctgagtccctgttccctcaactgtgaaatgagtacaatatttaatttaacacgttgagcacccttgatgtaccaggattcatagctgaaacaggcaccctattgagagtcagataatgacagcatagtattatgactgaggtaaacaaaattgcataatatttttgcaaacacccatgacagtgtttagcatacattatgatatccaatgactcttggtgatttctcctctttcatctctcattttctccactcattcaccagcccatcattcttctacaggtatatggagggttttgttactattcaaaagatctctcaggtcactatcctaatcctggaaactgggtcagcttgactcctgcctgtgaactcagcctagcagcaattctggcccaaagtgaccctgagcatcagccttgagggctggtcctcaggtcctgcttcctcctggttctgctcaaatgtgcctctctggtccccagccatttaccttctgtcttgtaccttgcttctccctgcttagttcctgccttgtattaccaacaccaggactcctctaagttagctttggccttctcagggacctgtgggtaatagagtaaagacatagactagttggattgtagactcttaggaaaatttattgacctcatcataaccactgtcattacagaagtagttaattacaatgtttagaagaagggtcagcaaacattgtctaccaaaggccacatagtaaacattttaggctttgcaggtcacatccagttgctttctcatattatttgtgtgtgtgtctgtgtgtgtgtattctccaactgtttataaatgtaaaatccattcttagctcatgggctatagaaaaacagatgacaggctgcatgtgacctgtgagccatgctttgcagactcccggtctagagctggctatgcagcatggtagctattagccacatgtgactatttaaatttaaaattaaatcatttaaagttatataaaatttgattcctcagttgtgctagctcaatagccatatttcaattgctcaatagtcacatggagctattggctactatgttgaacagcaaagacatggaacatttccaacatcacagaaaattcaattatacaacacagttctagagcctggctcaaactagcaagtttttcacagagttttctttagattaattccctgttcacactgcaatcccctcccccatatctattccattttcctccgagttaaatcacctcccatcactataacaatccatgccatgtccctatatgtagtggggactgtgatcaagagaaatgaattagtgagcttgcaaacttgactttcatcccaagttatttgtttcctaatggaaattagccagtcagcttttgaaagtcttcttctagggcagagtcttacatttcttggtcctatttatgttcttaccaacttctaaatcaatgggtaagggaaaaaccaagataccctctgtctcccacagcaaatagaagaatgtgaggaaccccagctctgactatctaccaacatcctaatccacccaaccccaaaagagactgtgaaagttctaaggagaagggaaagcagaatgttagagaagactccatccctctagaggtatcacctaaggagcaaggggagaagggaaagaagacaaaataggaaggtcagttcagggtgagctggtgccagcccctactggctcatgagaactaattgttacattttcaggaatcctttaaattatataaatacacagctaagtaaattatatcaaaaacaaaggtgataaatgcataaaactcatctcttcctaattatttcactacattttactatcatctagctcttgaggttatttatgcctatggtacatgtgtggtagaaatattatattgcggtttattgctacacatctcctcccaactccatgtttaataatgtcatgttggtagtttaaaactggccatggtggtttgttttgttttgcttttacccagacagccagttgttaaacatttaccagaataccactgctcctgtacaagccagaaaaaaagaaatgcaggatattaggcagctataaaccctcatcacagaagggcaagagaaaggaattcagaccaaggagggatgaaatttctgctgactctggacctctgcttctgaagctgagtgctgattgcagttcaccccagttctgaaggaacatcaccccaagtagaattgccccaacaccttgaaccatcctggctctgtgggttttctaccagatacctgttgccaggcttcttgaataccaaacacctgtctcagggcctctgaggattactcgccctctcgacttcccttgatttcctgtcccatcattggtttgatatcatggatgatgaacctgtttcaatcacagctaacaatgtttgtctccctccagtcttccctctcctggattaatctccttccagagtttctttcttattataaatttttgctattcctatactaatcatcaccttgctatgctgtaccccaccttgcctgagagatcggtcctctgaccctaaactttctggtctgaataaccctgctgatgcccttttttaatctactacatgagtacagctacccaaccatagagccataaacatggcttccatggaagggaagggcgagcacaagattaacttttatggctacatttacatttgttaaaaagtatttttataaaaaatagaatggcattttcaaggggcttggaagaaattaacagttagaagttttaaacaacctaatctaaatatacttataaacagtagaaaaaaatatacatagtgtattaaaggcaagtcacagaagatcaaattaaaatgatacatagtacagaagccaataggcacaaactcatttaactcttgacacaaattagttaaacatcatcattttttgtggcctgatctgtacactgtggtggatcaaaggagattagccatgttgccagagtgaggaaagaaaccacgaaagcagagcacatcacttacgtgtaattataatgattacaatgggagcccttggacttaagaaaaaacatgtagtgcaaggagttgctattttaaagaaagtaatctaagcattaccaaaattgctaagaaaagtgggggagaagttttaggatacagccacaaataactcaagtagtaaaaaaacaactgccataataatttgatggtgagaaagcaatatttgactaaaaattatatggtttttgtccacttgtgacttgaggaattgacttttattccccttgttattttccttacttattaagtgttttaaaaatattcattagctaaatgaaaagatattttaatgctccctttcaaatcctttgtgtagaactgggacttgggaactttaagggatatgatttttcttttcctaaacacttaccatctcctcttgtgtgacagtagcaataatttactgtgcataataccttgcattagccaagaagctacagaaatatttcatagcttcaaccttgacatagtgaaagcacaaccataaaaagataaaaggagcatgacagtagcctgaggtagttaagttttaggaagcattggttttgtttgcctgtacctgcgaagccactgtctttaaaggttgggtttggtcatcacactgaaagcaaacattttatataactgcccacagtttcattcattgaccagattattaagtaaaaagtcaacattatgtttgcttttcttgggttctctttgtctaacttggaatggcttattggatgcttcatattatatttgtctttcttttaaaataatcctttcatatatgctatctatgcctctataagaacatgctatatccaaacaaagtaatcttacagataagagcctctgcctgccttccccctctcatccatggatggttatataagtggatgtaccctccctccaaacagtatctatccctacaaatggctaatagtaagaatagccttgggttcaggctttaggataaaaatctttatcttataatgcaatatgaacccataaagatggcatattagagaacgcagtgcccattgaaagttaaaatttatgtgagtctgtctacactctaaagagatctttttttgtaactttttggtagtcaataatatggatcaattttcaaagaacttagggttataattttttatttataacaatctttgattcaaatgggatttagattcacacaaagatgcatgcaagagagcataaatattggaacaaaagtaaatctgaaaaacaaggaaaaaagaagagaaaacaatatgtatgtcataattaatttagtatatcaaagtttaataacctcgaatggacttgagatggagttaaggaataggtggggagtgaggcaagggatgagcaaggaaccgctggatgttagtgcaaaatgctgtgggtatgcttgacccacatatttctgtcccttcccccttcatgaatcttcaccacaatggcagatccttgaggctagatatacagtcctcgtgtatctgtggaatatctatactatgtcctggaccacgtgagcatgactcagtaatgatctcacaataggacgtcactctccattttgacggtatctactgtatctacctcctttgtacattattttctcctctgagtgctttccccccattttaagctaataaaacaaacatgcacactattacagcacttatactgcaccagataggaaaacaaatatgtatctattttggctaaaaatcttacattgagaactatggacactaaagaaataaagagatgattcctctttaggaaatatagtcatttcatgttattttagagacatgagaatttctttaaagttaggaaagacatgttgttctctgctctccctccctgaagttcaaaagtctaatttttttatagatacaggtataatctttcttgtccctgcttttccttttctcccattacctctcccttactccttctctcccttcgtctcttctgccttcccttcctcttccccacttcccttttatatctccttgaccatcccgttgcattatatcatatccttcatcaaagagggaaagaggcccaccttttgtacaatatgtaggcctgatgttttttaaaaaagagttatttatctcaaacaggctcagtcactgctaagagtgtagaaaggtactttctttccttgaatctgtacattttcactataggaagggctatttagtgcacttctccagcaatgtagccaaaaagggctaatgcattttaaacatttaaccatgaccaaaatttggagctgaaaactagtgatgtgataaaaatattttcaacatatttacagtatttttaaccccatatgaatctttgtcccgaggggagcaaatctgcctccaagggaaggcactttttaaattatctatcttattttcagaaacacagatagccttcaagtaacttaccaagaccaccacggcaccttttggcctcacctatatcgcctatgcagaagagataaaactttcctttagttcctggcaacatgacccatagagggttaaaagagaatttttgcactaaccttttatttatatataaggtgcaggtgtagacaactgaatggaaataaaggggaagtatagtttgggtaaacatttacgttttaattttctcttaatttcttgaggcccattatgtgtttatcaaggcatgcaacagctttaagttaacaatgcaacaatgcatcattaaatgtataccagatgttcctgttctggcacctattactgagagccctcaacttgcctgtcaagggaaagaaaaaaaatgtgtgttctcctttaataactaacactaacccatcaaaacaaggagcaataacaaaaagactctgacacattgctttgataaaatactgcatggaaactcattagtgtaataggctacggatgaaccagcatacccactcctcagccatattcttgaggagctgagtaataaagacactcaacagaaggttaagcctaaggattgaactgctgatgcagttggaaatgatgggcacatagattgcccttgtgaatcacaaatacagaggacttgggagttagatgaaattgacagcaaagagtatcagcaagcccattcagaaaacgggcaatatgtgttttggaggctcataaactaaaatgatacaaagaaagttagagcagatggctacaggggcataaacattctaaaatggtttttaaaaagggagctttttatgggagatgtgcagttggatctgggaaaggattaaaagtagggaagttataactagctcttccttttttcttctgattaatttacctcccagagagcagttacttaaataagatttcatagatccactgtagcaaatcctgtgaaaaggtgacctatttcccttgtggctgatagatttatggatatctttccatatcaaatctcagcatggaaaagtggcaggcagtggggaggaagaggagggagactggatgagaataactgtacatgtaaaatttttgttgttccttaattgaacaaaattaattgagacaagtctgcattcctgttttgtaggcaattttaatgatttttggatcacaaatgtattagaactagaatgaaaaccttttcaaatgttaaaatagtccatgcagtttgccttgtatgagggaatatgttctcttttacctaaactgataaactcaaggtttacccagggagaaaaaatcagaaataataaagtttaagggagctgtaaaattgctttgaaatatgtcgcacacattttcaaggctgcagctttgcccagctacaatttatggatgaagttcagatctctatgatgctctagcatgaaagtggcttccaggaacctttggggatgggatatttgggatttagtttatcttatttaattctactttctttgtattttctcttataaatgaaaacacggtgtatcaaagctttgttaatattgtattagtaaattgaagctccaaacacagcaatgaaatgcagaaatcctctgttagatcatttaaatagcctttcttatttcacagtgtcgttatttttaaacagcattgtcgaggtgtaattgacatacaacaatgtatataagatgtacaattggatacttttgacatatgtatacagtgtgaaccatcatcacaatcaagataatgaacattctcattgccaccaaaaatctgcacatgcttgttgaatatctcccccaatccccagtaatgactgatatgcgtttcatcactacatattaacttgcattttctattaatagagttttatataagtgggattctacagtatgtgctctggtgggtctggccctttcactgagcataatcactcagagattcacccttgcggtttcacatacccgtattcattcctttttattgctgagcggtattccattgtatggatatacaaagtgctaggtgatgctgggccctctgttgaaaggagtctaggaactgagttggtgataacaggaatcctgccacctccaggtccattcagcatgaggcatgatgggatgcttaataagttatatcctctcacaaaggaatttctgaacctgccatttgagagcatgccattgagttatgattcctataattgagggaatggagctatgcctcccactgaatgatctgttgggcctttcggaactgagaccaaaataaagaaattaacataaatagtgcacattgcaaattagttgtttctgcatcaaaattaataaaagcaatggacccaggtgtctggggatcttttccaaattcttttggtttgaatgtacttaaaggattactattccaagcgccaggaactaggatacttaaaaaatgacattaagtgtgtatgtgtatatatatatacacacatgcatatgtacacacacatatatatacacatgtttgtgtataaatacagacatatatacatgtgtgtatatatatatatatatatagatataaaagtcattctatttaatgtcattgaatagaatggcacttttattttttgttttgttttgtttttttattttattattattatactttaagttttagggtacatgtgcacaatgtgcaagttagttacatatgtatacatgtgccatgctggtgtgctgcacccattaactcgtcatttagcattaggtatatctcctaatgctatccctcccccctcccccctccccccaccccacaacatcaccccagagtgtgatgtcccccttcctgtgtccatgtgttctcattgttcaattcccacctatgagtgagaacaagcggtgtttggttttttgtccttacgatagtttactgagaattatgatttccaatttcatccatgtccctacaaaggacatgaactcatccttttttatggctgcatagtattccatggtgtatatgtgccacattttcttaatccagtctatcattgttggacatttgggttggttccaagtcttcgctattgtgaatagtgccgcaataaacatacgtgtgcatgtgtctttatagcagcatgatttataatcctttgggtatacacccagtaatgggatggctaggtcaaatggtatttctagttctagatccctgatgaatcgccacactgacttccacaatggttgaactagtttacagtcccaccaacagtgtaaaagtgttcctatttctccacatcctctccagcacctgttgtttcctgactttttaatgattgccatagaacggcacttttaaaacaaatcatacacaaactcataaatcacaagcaaatagcttgatggataaaatgaacacaaccatgcaaccaccaattagatctagaaatagaaccctactggtatttaagaagctctaccaggtcacttcccagtcattatcctcaccttcatccacaaaggtaaacactagcctgacttctatcacaatagattagttttgtttttgagttttatatacgtaccatcatgcattatatatacatacatatatataaaatacgtgtgtatgtgtatatatatatgaactattttagtccacattaatgagattactccatgtaatctttttaaaatttttatgttaaatttcattgaatgagtattctacaatttatgtatgttaccagtgttagggtatcatgaacaatgcttcaagagcattcttacacatattggacatatacctaggagtggagaagtggaactgctgagtggtagggtatgcatatgttcagctttagtagataaagccagttttccaacatgagttgtaccaactcacagttctatcagcatactatcagcatatgaattcctgttgcttaatatcattgtacaatcaggttgtttaagtttgaccattctggtaggtctgtaataatatctcatccatttattttccctgaagactgatgaagttaagcatcgtttcatgttttcttaaaatttgaatattctcttttatgtagtccctggttaaattccttgccaatatttcttaattgcattttctttttcttattgatatgtaggaattcattatatattctgtatatgtgccctttgttagctatatgtattgcagataccttctcccataatgtagattgccttttcacttgttaaatgtgtctttaatgaagagaaattttaaaacttttaatgtagtcaatgcttctatcttttcatatatggtatcttttgtttcctttttaagaaatctttgcctacttcaagatcataaaaatgttctatgttacattctagaagctttaacatttcactttcacatttaaacaagtaatccacctgaaattggtatttgtaggtgatatttgtagatgatcaagagccatgtttcccaattgaatatggatatatagttgacccaacaccatgaagagattgttttacatagtgccaggcaatgcctcctctgtcataaatgtccaaacatgtgtagatctgttgggttatcagaattgctctaagtcttgtgatggttaatactgagtgtcaacttgattagattgaaggatacaaagtattgatcattggtgtgtctgtgagggtgttgccagaggagattaacatttgagtcagtgggctgggaaaggccgacccaactttaatttgagtgggcacaatctaatcagctgccatagaggctagaatataagcaggcagaaaaatgtgaaaaaagagactggcctagcctcccagcctacatctttctctagtgctggatgcttcctgccctcaaacatcagactccatgttcttcagttttggaacctggactggctctctttgctccttagtttgcagatggcctactgtagggccttgtgaccatgtgagttaatgcttaataaactccccttcatatatatatatgtctgtgtgtgtgtgtgtgtatatacatatacacaatatatatacaatatatacaatatacatatatacaagatatatatgtatataatatatagtattatataataaaattgtacatcttttgtacaatatattatatattatatatatatgtatatatacacacacacatatgtataatacatatattagtcctgtccctctgttggttctgcacttccatttgttctgtccctctagagaactgacacaagtctatacatcagtttaaaaacagttaatatcttgacaatattaaaatttccagtctggggactgagcatgttcctccacttcaagtcttttaaacattttttcaaaaatattttgaatttttttgtgtagaggtgttacatattttataagatgtatttataggtatttattgtttgtatgctattgtgaaagatatttttgtttacttgttttatcttgtgttcattgcatatatgtttgtttacatggtaaccttgataaaatcactttttaattctaatggttaatcagttatttgtattttcttcttatacaaccatattatctgtgaataatcatagttttatttcttccttgccaaaccttgttttatttttattgtctcattctacctccagcaaaatattgaatcgagtggcaatggtaggcataattttcttaatccaatttctgggggaaaggagtagttaaaagagaacagacataatattttagcattaactgtagtattttctgtacatttttatagataacttttattaggctaagaaaataccttttattcctagtttgctaagttttttttaagttcaaggatacatgtacagaacatgcaggtgtatggcacaggcatacatgtgccatggtggtttgctgcacctctcaacccatcatctaggttttaagccctgcatgcattaggttatttgtcctaaagctatccttcctctccccacctacctgctgacaggccctggtgtgtgatgttcccctccctgtgtccacgtgttctcattgttcaacttccacttatgagtgagaacatgtggtgtttagttttctgttcctgtgttaatttgctgagagtgatggtttccagcttcatccatgttccttcaaacgacatgaactcattctttttttggctgcatagtattccatggtatatatgtgccacattttctttatccagtctatcattgatggatatttgggttggttccaagtctttgctattgtaaacagtgctgcaataaacatacatgtgcatgtgtctttatagtaaaacaatttataatcctttgggtatatacccagtaatgggattgctgggtcaaatggtattgctgattctagatccttgaggaatcaccacactgtcttccacaatggctcaactaatttacattcccaccaaaagtgtaaaagcactcctatttctccacatcctcaccagcatctgttgtttcctgacttttgaatggttgccgttctaactggcatgagatggtatctcattgtggttttgatttgcatttctctaatgaccagtgatgagctttttttcatatgtttgttgaccgcattaatgccttcttttgcaaagtgtctgttcatatcctttgttgcccacttgttgatggggctgttttcttcttgtaaatttaagttccttgtagactctgaatattagaactttgtcagatagagagattgcaaaaattttctcccattctgtaggttttctgttcactctgatgatagtttcttttgctgtgcagaagctctttagtttaattagatcccatttgtctattttggcttttgttgtacttgcttttggtgttttagttatgaagcctttgcccatgcctatgtcctgaatggtattgcataggttttcttctagggtttttatagttttaggttttacatttaagtctttaagccattttgagttaatttttgtatatggtgtaaggaaggggtccagtttcagttttctgcatatggctagccagttttcccagcaccatttattaagtagggaatcctttccccattgctggggaaggtttgtcgaagatcagatggttgtagatgtgtggtgttatttctgaggcctcagttctgttccactggtctatatatctgttttggtacaagtactatgctgttttggttactgtactcttgtagtatagtttgaagtcaggtagcatgatgcctccagctttgttctttttgcttaggattgtcttggctatacagatgtagaatttaacaaatgcttctcatttatctattaaaataatcatatgattttctgtagtattctattaaagtgaggaattacatccattttttaatgttgaaccaatcttgtatttcttaaataaatttatctttgctattttatatcattatcccttttataaatcactctgtaattttctaatattttgtttgggatttttagatttatgtttatgagtaagtttggccagaaattacatttttttgttgtaatattcttgtaaggtgttagtattacaactatcttgaatgtttgtgagaatgttagagaagccattttagcctgaagttttctaaagatttttatttacatatttatttatgcatttaatttctatagtagttagaattttatgtagtattatatacatttgttatttcttcttgagttagttttggtaagttatttttaggaatttgccttttttcaaaattattgttatgagtgtcttataacatcagctcattctttttctaagagctacagaatctatattaataaactactttcttggtcatatcggctctctctctcattctcccctaccaaaaatcatttttttctttacctcaatctctatcttcttttagaactccaatgatatatatcttaaccttttgatactgtctcacagatctctgaagctctgtttatatttaatttttttctagttctttctattggattatttctattgctctctcttaagtttacttacgctttcacctgtcatttcccttctactaaatatatctagtttttaaattaaaattttttttagttctggaagtccattaaattatttagtttctatttctctactaaaatttcttatctctttagtcattatgaatatgtttccttttcatctttgaacatagatatcatggctgctttgaaattagatgctgctaatttcgacatctgagttatctcaggtttagtcaccattgattttcttttctgttgaaaatggatcgtattctcctgtctcttcatatactgaagaaatttgagttatatcctggacattgtgattgttatgctgtaagaccctggaatctgctatgctcctcagaagaatattaatgtttttgttttagcagacctttagcttagttgaactgaaattgcaaactctatctcttgagtggcagatcaaagcttagtttaattcttttatcattagctgtagtctgactcatgcaatgcatgacccagtagtcagctagaaatttggaccaagattatacatagaatttgagacttccccattcaggcattctcctttctgggatttcccatttaatttctagtaactctggttgtccttaactccgttctctgattcttcaggcaaagggctgtgagttttctattagaattatagctaccccattgttatggtctaaatgtttgtgtccccccacaaaatttatatgctgaagacctaacctcctcgtgtggctttaattggagatgggacctctaaggaagtaattaaggttaaatgagttcataagggtgaggccctttctgataggattagtgtccttttaagaagaaataccacagaacttgctcttccctcacacacgcacaaagaagaggtcataggagcacacagtgagataacagtcatctccaatttaaggagaaagtttcaccagatgccaacccttcttacactttgacactggacttccagtctccagaactgtgagaaaattaatttctgttgtataagccacccaatctatggtattttgttatggcagcctgagaagactaatacaaccatggagtcctgatttggcctattctcaggttaaaagccataaaaccaggcaactcacactgcatcattccttttcctgatgtcacttccttccagaatctgcttgtttttgttcactctccaacttcaggttgttgcttttgtattttgtccaaagtttatacttattatctggggaagagtcatgtctggtaggagcttacctggtgatagaagtagaatacatgtttatcaattttatttgtattttcaataaaccatctctttgtttattctctccactgtatatttgttttctgttccattaatttctgtttttctcttatcttaagatatcttaagaaaattaattatcttaagatatcttaagaaaattaattatcttaattatctttctttttatatgtgtgtgggaggcttcatttactaagtttgtattcccaacctgctgaaatgtacttagatcattgacttgttagccttctttttaacattattaaatgaataatattattagttatgcttttcaaatcctttgtattaaattttttgactgtttattctattatttactgaatgaagttattaagatatcacactacgcttataaaaatgcctttctccttttagttctgattttttgctatatatattttaagtgtatgttattagatttaattgttctatagtccaaagaatagttcttttaatggtataaaatactcctctttatctctactaagactttttgctttaaagactatattgtttaacagtattgtcgagtagcccagctttcttttgcttagtgtttgcatggcattaatttcatttccatatagaaagtaaaagtgttctgtttccttatatttaagtctttttaaaataacatagagttatatttttatatttttatccaaatttgtatccaacctgtttttatctcataattgattggcatactaaggcaaaattatggcaaaatcaatggaactcaattctgtatttagggtgaactataaataatcacagttgtagaggcagacttaactattgccagaaaaactgctacaacaaaatggcaccctagaccagaccagtaaataatgagaaattaatgtcagcctcaatgagaaattaatgtcagcctcactatgtaatatttttatttattgtaactaattattgtgagttaactttatattattttatttcataaatttattctcaatgagatctttttattatgttatttaaaatcctaaaataaggaaccactataagttatctaatacaccaaggatattaacgtgaagtctagtctacagatcctgctttggtagccatgggtgagtaccaaattctgtacagatggatggctaaacatttttctggggagaggttctaaagctttgatctatttcttgaaaaagtctatgattccctccagatttaagaacacctggtatcccatcagtatctgaattcaggtccccagagtaaataaaacaggggaagcaattcctttacagaatcctgctttgacgaggtttacttttaaaagagtatgccaaactatataatagaatataataatatgcaccacaccaaatcccatctgaactgttatctcaaacaaactgcctaaaatggcctgctgcgtagcagttttctataaacttgggttcttttcctccccctttatcactagctttagtgcactgagaaaaaacatcaagattgggagattgtgattataaaggaaaaacagatttcttccagtagaatcaatatctataaaattgttatttcactggtaacatttgaaataataatgaactgtataatactttcattttaaggcctatgggttgctcaataaaaatgtttaaagcttatatatttttcaaatatggcaaatgttaagttttaccaccatggagatttggtctttatactgctatattaaagtgttgtttgtgcttttctaattctttttcattaaaaaaaagatttagcaaatttgaataaaattggctaaaaagtaattatgagatcaaattgatctgcattatgttggaacatgaaaccacattagggatgccagaattcagattggaggtaagttatccccagttgatgttactagaatatgggattaagatttacaaaatcaactgttgactaaatgttttgtgatacttacaaaaggagaaatgtgaaattacctaatttgcacttgcttgtggtatggtaatttcatgtgaacagatattcctttaagctgccacattgcttttttttttttttttttttttttgaaacagagtctcactctgttgcccaggctggagtgcactggcatgatctcagctcactgcagcctccgcctcccaagttcaagagattctcctgcctcagccctcagcctcccaagtagctgggattacaggtgcacgccaccacgtctagctggtttttgtatttttagtagagatagggtttcactatgttggccagactggtctccaactcccaaccccaggtgatccaccagcctcagcctcctgaagtgctgggattatagacatgagccactgcacccggcccacattgcattttaattagagtcctttatttttggacaatgaccacagaataactactctgaccttcagtttcttaattactctctggaaatgaatgaatcgacaaaaaaaaatagtttttaagtttccaagcctgaatctaaaggtgacattacttccatgttcaactgcagtacattcagctttaaaagactattttacagaataaggaatttgaatagaagaaatttctagaaacattctttacatatagccaccgtgtccctgaaaagaaatgctaggacacaggattttgtgattagtgtttttaaaaacacttaatccatctttcttgcttttcaattacttttttcaaggaaaattacttttctaaacataagcagacacaggtctagaaatatttgacatgaaattataaagtagtgttaaaattatatctacaatcaaagccgagctccttatgtaaccttaccattgatttgaagaacttcctttattacctgacaagcttgctcattctgtacatttattttgattttgttggactttcagccatgcctataatgttgctgaggagtaaagtatcttttataaccagaatcataaatctttcttataaccaagagactatatctgtatggctatagatattagttactgtcaaaaagtgccatcttatcatattacgaattagaaaactgaaagacggtgcatggctgacaatacctattaagtttggtattgtcaaaccaaataattttcctttctaatcaggcaatatttctaattacaaatatttttagataaatataaattatttggatatgtatttagccagattttgaaagcacaactagattaatgtgagcaaacaaaatggatatatttatgaaaaagtactcattcaaatggaaaaggttaaaaaaaaaaaagacatggaaaagaaaaaaaactgacccatttgttttatgaggggtgagagaaaagtgttatttttatttcaatttttcaagcaaaggttttacacagattcagtaatgggataactttccagtttcttcttgccaagaacagatgttattgtctagatgttcaatgtatggcctttattgatagtttgaatgtctgctcattattaagttactctagaagaaaaacaaatagaaatgctgataaatagaactttaataacaggatgtttaaccttttgtgttttacttaaactcttttcctgctctcaacgttatgtaatagtaattttatatatatttatctcataaatagaaacagggtcttgctctgttgcccaagctggagggcagtggcatggtcatagctcactgcaaccacaaatttgggctcaagagatcctcccactttggtctttcccactgtattgggattacaggtgtgagccactgcgcccagccagtaattttatagatatttttgtttgttggttttttgttttttgagacggagtctcactctgtcgcccaggctggagtgcagtggtgcaatctcagctcactgcaacctcagcctcctgggttcacgccattcttctgcctcagcctcctgagtagctgggactacaggctcctgacaccacgcccagctacgtgtgtgtgtgtgtgtgtgtgtgtgtgtgtgtgtgtgtgtgtgtgtgtgtgtttgtgtatgtgtgtgtgtgtgtgtgtatttttagtagagacggggtgccaccgtgttagccggggtggtctcggactcctgacctcgtgatccgcccgccttggcttcccaaagtgctgggattacaggcgtgagccacctcgcccggtcagtatttttaaagcaattggtttcttagaattcatcacatctactgtatcctgattgtgctgttctgaatgaaaactggatgccatagaaatgcagaaagttagccatgaaatttcatgtactctgcctgtctccctaatatatgtatgcatggaagagttttatataaactggggctttaagtgagggcagtggaaagagaaaagggactcaccagcacttttgtgctatttgtctttttggccttagatacattcctaccttcccctgctttgctagggtgccgaggcttaaaaatcgtattaacaaggctcctttgccaactggcttctagctaggtttagtcaatgggagatactagaaggagataggatgcaaaaggaagtaagaagccatggtatttctccccctctcaccatgctttgatagcttttctatcaacagcttcttccctccgtggctccagctttctccaggtagattcactatggttctagcttcttctgagtggtccctgctccaggctttgatgccccttctttcctttgtatctctaaccctaagatagtggctctggcttcctggagttgctcatctctgggctgccttgtgtttcctgcttgctcttttagttcctctaacacctttgtagctagggcatatccagttatttcccaagttgctgtggcaaatactactaagcccactttctcctatatgcttccacctccagtttgtttattaagccacaaggagactgcagtcttaggatgggagaggaaaaggaagacacccaaaatgacatggatacattgtctaatgaaaagggagaataaaagtaaaactgataccagcaccacacacacatattaattttttaaaaattggcatttaatctctgcataattggtctttccttacacttgctttaagtcaaaagctcaaatagatggattccagattgtattatattaccatctttctatctaggttcatgagtagggctaattcccctctctgactaccaaaagatacaaggaggatccagtattaatagtgactctggccctggttgtggtaggaggttaatgaaacttagaatatgtgcttggagagcctgaaactcccactgagaattaattttgtttgctcatttcctaatggtctttgtggtcattagacttactgttatttggccctagatacattttctttttacttttggcttttgttacacagggttcagagctgaaagcatctacttcttaaaactactgagtggttttctaatggtcacagtatgtgggaactgagcattctgcaaagctaaatgtcatttggtacaaattatattgggtaatttgtaacccatctaactgctctttcttgatgagcaaattctctctctctcttgtgtgtgtgtgttttgcatgtatgaatatactgggagtgggagtcaggtatgattttttaaatttgactttcattctctattaaagggcatgaattcaccagacattcataaccatctttataataagaaataagtgtactaaaaactttgttgtgtttcaaattagaaaactaagagcatgttgctgtaatcttggacacatgtttctatctctatggtgactgtgttttccaaaccaaaatttaggacatgtgttatggcaaagaatttcctttaaaattgttcttaacacatggacacagggaggggaacatcacacactggggcctgttgaggggtggagggctaggggagggatagcattaggagaaatacctaatgtagatgacaggttgatgggtgcagcaaaccacaatggcacgtgtatacctatgtaacaaacttacatgttctgcacatgtatcccagaatttaaacaaatttacaagaaaaaaacaaacaaccacatcaaaaagtgggcaaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaggatgtggagaaataggaacacttttacactgttagtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcaccattcacaatagcaaagacttggaaccaacccaaatgtccaacaatgatagactggattaagaaaatgtggcacatatacaccatggaacactatgcagccataaaaaaggatgagttcatgtcctttgtagggacatggatgaaattggaaatcataattctcagtaaactatcgcaaggacaaaaaaccaaacaccgcttgttctcactcataggtgggaattgaacaatgagaacacatggacacaggaaggggaacatcacactctggggactgttgtggggtggggggaggggggagggatagcattaggagatatacctaatgctaaatgacgagttaatggtgcagcacaccagcatggcacatgtatacatatgtaacaaacctgcacattgtgcacatgcaccctaaaacttgaagtataataataataaaataaaataaaaaataaaaaaatttaaaaaaaaaagattttttttttttggagatagagtcttgctctgccgcccagactagagtgcagtggcacgatctcggctcaccacaagctccgcctcccgggttcacgccattctcctgcctcagcctcccaagtagctgggactgcatgcatccgccaccacgcccggctaattttttgtatttttagtagagacgaggtttcaccatgttagccaggatggtctcgatctcctgacctcatgatctgcctgcctcagcctcccaaaaaaaagattcttaaattgtacttatgtaatcactcttataagggtataaaaattcaactacatttcatgctcattttataattgtatttttaaagagaaaaatgtttgtaaataagaattagtcttagaaaacccatgatattgactcctactatgtcttttcattcttctaagaaatgatcctatttgttggccttatttcataatccatagaaggactaggaaaaaatggaatagtcattggctcattcggaaaacaataatgttacttagttataatactggaatagcgggtatttaagaatcaaaattttggctgggcatgctggctcgcacttgtaatcccatcgtgttgggaggccaaggtgggaggactgcttgagcccaagagttcaagataagcctgggcaacatagtgagacactatctttaaaaagttttcttttaaaaaataatcaaaattcacatgcagattaaactggaagctgaaaattcgatcccttaaaatagcccccttaatatatcccctttgttctgagctgcagtaatatgcttctaagagttaagaagaaaaataaatcatagcaaatagtctcttctctaggaaaaaggtataaactaaactttcctcaaaacaagattaaaatcagttagaaaaataaggcaaatcccatccaggtctttcgtgcaaacgagttttccaagtgaaaaagtataaggacgcagttcctgggtaagatacgaaggctgttatgaagggaatcactggccagagaaggatccgcaagatataaattccccgccccattcaagaacaatgttgagcctaaatgggatgctcattgtaagctctgaatcttcatctgggatgctcatgtaggaaggtgcctgtggaaccaggtatcaagagtcagaagacaagcatcaaaagccataagggggtttgaggaactctttcaagaataaaactggaaggtatatctccatggttcctaaataccagctagagagaaaaacgggaagtatgcatcaggaactttggcctaaagaagatgtgtgacttcttaaacttttgtagctttttcatgcttattacctatttttatttgcatttctggcaatagataagatattctcttgcttattgtcctggaaacaagaagaagcagggaaacaagaagcagcaacctgcttcttctaggacaataagagacaataagagaatccaggagagatttctactgggttttccaggacaataagagaatctggggagagcacatctaacttggtgtcctagttggtgaaagaagaattcgaggattacggaggaaagaaaaataataaatccatggagctggaggaaaagtgccaagaaggggagttatggactaaggacttgggaaagagaaggagcccagaagttaatctggaagtgggcacctttgctcacaccagagtctcatcggtagccccttactagctcactttccaagctccttgactccacaaatgctataatagcagcagagtgtatatgagaaagcattttctatcagctagttggttattaggtcattcagtcttatttgctaccccacctcccctgtctccattgtaatcccattaagagcagaaactaccccattcctttccttatgactctgtattatctataactatgacacccacacactttttataaatatagtaatgagcccaggagttcaagatgagcctgggcaacatatgagaccctatctttaaaaagttttcttttaaaaaagaatcaaaatccaatgtcttatgttgccccttcagctcagtgccattcccagaaggaatgaacaaaggaatgtcccaaaagaacagaagaatggaatggggacaagatggattgggatagccaagtgctcagtacattttttaaaaagaagtttctctctcagaacagaagtgacttctcaagagttagagacccaactctgcacagatagagaaaggctgcttgggtctctaatttgcattcaaagcccaggtcttagctcaaatttctttcccattagtatacagagttatcttcagtacagtcattttcaaggtgagctatttttccatatttttatcccaacattttattatgaaaaattttaaacatacaacatgtatccaccatctgaattatataatcagtatattactatgcttgctttgccacaaatctgtctagccatcaagtcattgttgtatgcatttcaaaatccaaacatcataacttcccccgaaatactttagtatgtatattagctagaacatttgcttatagattttaatgcaaaatttacatgtaatatacaaatcttaagtgtatatctgctaagtttctttcatctgctgagttctgagaaatacataatcagtgtgatcctaactcctattaaaatacagtattatatattacattagattctctctagcattatcatattcccagagagttccctcatgcccttttgcagtcaattcccacccttcaatctctgccagagtcatcagctctgattttttttcctagatgagagtattttcatgcttgacagagttgtgcaaataatggctttagtgatgaacctttgtagttggccaaattttagggacatttggcttcaacccaacaaaaagttaacattcttaaatgactgattattgtagataaataagaattattctattgcataagtcatcttcctctcctgcttattcatacctaatagcctagataagaaataaagtacacattgtctctgcctgataaatcagcaatttcatttgtctcataatgaagggtcaaggaagttcttcaatttctgaatatagtcatgtgattactggtctcagaacacagaacaaaaagagaacagattttgttactactaacaagctcttttcggccaattattcttccttatcaataatattaatatcctagaaaaaatgtaaatacgataactacatcttgccactcctgtgtgtaagttaagaattatggaaggcttatgattcttcttgtaagtcagtgggaagctgagtagggagttactattgaattgtgctcaggaatggtacctaatggcttacgagagtgaatctgactgctaaaatggcaactgcctgcaggatgtggctttccgacccattgttttgcaaattaaatggaaagtttttgacccctgtggcatctttatgtccaacacgtgatctttgcagtggtctttgtttgggttttctaatagctggtatcattcttcctccttatcccactgagttaagtttctttctggattctctttgctaagtcccctacagcccctccccatgtctctttttccacgcatcatttcatgttttattcccatcattggacttgccatttcttcatgtaaattcccaccccttccattctcccccatcactctcaagttgccccccttcacttattaccctttttgtttctctttcctgctgcttaatgatttttcctgctgatgagctgtgctcacaatactgagaggcctgcagcaccactgggcttgttgcttgctcatggggtgctccgagcagatggaagtagaattcagtcatgctcatcacaggacagctctgcgatggtgtgtgaatcttgtaacattccatcagctttttcgttaatgaacctatgggcttcccttttttaattattaaattggagtttgatactctggaaagcatttttctgttgaagacttatttttggtgctgtatttcagaaacagaaataatcctgacgtttatacacacagcacaccagattcagtgttttttatgatatttgtatagctctattctttgtaaagtgtattcttacacagtgtctaattgagtctagtattaatgattatcagactagggtcattatttttatgattgtcacttttaagtgaagaatgtccacaaggattacagtgagggagaatctcagaataactatgcttagccagtcagtacagaagctaatcaggagaatacctcttttataagaggctaatgaaaaatttacttttcccccaccccactgggttttcctccactgaatcaacaggtaaaataaaagctgtcccatgagactgggatctttcttaaacaccttgcagtggtcaggaagttgctattccaataattcatcagatgccaatatataatgtgctgggacatttagccatatcagttaactgtcatgaatatacagacattctgctcttgaccttaaagatatgctcctagaaaaattgcacgtagatcaaattattgtacatgaaattgtgttgtaaaacacaccagggtaatttgctatttaaagaaatcttgtagtttttctcggtgtaaagaattctttcatgatgcaaataatccacattttatttgtaaatgtagggctctaggcatgagtttgtgtgaaggacacatcaattttaatggacttaagtagatggtggtttaagacacacttttctgaaccacccaggggatcccagcaactgttcagtcaaacaaagggacaaattaacccctctggagcaatagaattctgccattatttaatgagttgatatgagaatagcaggtcctttcccttctcctgcagtggttttacctttcccagtaattgtttccttagagtaaacttgagctttatatttgtgaaaagcagaaggaattattttcaacaaaccacatgtgcatcaaatacccttgaactaagcatacaaggatatacaagtgctttccttgcatttcctgaggtagagttcagaatgttacctttaagcctctgaatgctccttaagcaggctttgtaattcctagtttatgccctttgaaccaaccctaaattctctcaatcctttgctcgttttcagttcacggactaaccaccactatgcccttggattatttacttcctctgttttcatcaacatatgccaaattccactttcattaaagaatttaaatctaactaataaacaattatccttgatgagcaaggtatttctaagatactcactgctgaggaaagtatagtttgtaaccaagttatgttccagaagattgtcccacctccactgtgggttaatgtcctttccaaggaggcagcctcgagaactttagagctaatgttcttcagggagggaggtaccaactggctacctatcagctgagtgtagaaacaactgagggtgaagtaaatttgcctcagctaccaggatcctttgacactacgccttctggtttctgtggcacaatcgatcaagacagagacctttaagtgtccagattttgttggctacatttagctgtatcccaagctacaagagttaagtaatgccctagtccgtgcccaggagggacttccataaagtttttgtaagttgccaactctcagtgacttcacaagtcttttcccaattcatcctctcccagaagcaaccacatgggagacaagtatgaaaattatacttaaggagataaaattaatgaactgggtgccacaattggtgcaatttttactttttttttcctaggaggtctcttatcttgttctgtgacctcaacccaatctttgatatttcagctaaattgtggccaaaatcctttgctctccatgacaaacttctaaaatcctaaattctagatttgacaaaacatataggaaaggacaaatattctttacctttctcatggaaacttattttgaaagggtgggggttataactgtgtttgacatctttagatatgtctgttttagtagagatattacaactcagtcaggagagaggaaaaagaaaaagaggactgcatctgcagatgccattcttcagagaacgtcagctccctggcagcaagttggagttgggaagcatacaaagcttgaagatcagacccctatgaatgtaatacttacatttctttaatattatccctccatgtgattaatattaatcctcaattatgtctccacaattctcaatatagacacttggaggctgccacaatgttacgtaagaggaatggagttaaaagtcattttctttttatatactttactattttaaaaaattttccatgatgagagaacagataccatctatataacctatagttatatttatgtacaaatataataaatacctagatatacctagatttatatgttttataaatttatgtataaatacaggtaatatatgctacatatataattatttttttaaattaaaaattactaaaggaggccaggtgtggtggcccatgcctgtaatcccagcactttggaaggccaaggcaggaggatcatgtgagccccagagttcaagaccatcctgagcagcatagttaaaacctgtctctacaaaaaatgaaaacagccaggcatggtggtgcacacccgcagtcccagctactctgaggctaaggcaacagaatcactttagccaatgacttcaaggttatagtgagctatgatagcacactgaactccagcttgagggacagagtgagaccctgtctcaaaaaagaaaaaaaaagtagaaggaaaaacagcaatcctctattgcatatcaaaatctaaatgtcctctcacatatctcttacatgagaacgtaccttctctttatgtatcttcaatggatttctgcttcaacaaagcacttactgccttctgcctgccccattctcccgttcctaacatacaagactcttatttttatctcctttatgccactcacatttctcagccaaatcatgcactttcctaatctcaatgctcaactaaaactttactttcttcaacaaattttcctttatcagtcccaccctaaaattcattttgtcaaacttctgtaccctgcactcacatatacttgcctatgtgttacattgtgaatgtaaatattttattgggggataatgcacacacagacaagtgcataagtcctaagtgtacagctggaggaatttcacaaagcaaaatccagatcaagagcatgaccagcaacgcagcagctctccccatgctccattttgggtactttcctcctacctctaccaagaggaaccgttatcttgatttttttttttttagacggagtttcactcttattgcccaggctggagtgcaatggcacaatctcagctcactgcaacctctgcctcccgagttcaagtgattctcctgcctcagcctcctgagtagctgggattacagacatgcgccaccatgcctggctaattttgaattttcagtagagacagggtttctccatgttgatcaggctagtctcaaactcccaacctcaggtgatccacccgccgtggcctcccaaagtgctgggattacagttgtgagccactgtggccagcccattatcttgaattttaacactgtagattatttttgcctgtacagcgtatactcttttatatctggctttcactcaacattatgattttaagattaatccattgttgtttcatatggcagtactttgttcatttttgttgctgtgtaatatcccattgaatgattattcctgttcatttgaattttgatggacatttggtttatttccagtttggggctattgtgaatagtgctgacatgaatactctcacatatgtcttttggagaacagaagaacattttcctcttcagtatatatctaggagtagaattgctggatcatgtatgtgcatgtgcttagctttagaagatcatttcaaatagttttacaaacatgcaatgttgtttttttaaaattatctcaagctagagttctttgatggtcaatcatatggcagtcaatgttgatgccaagcctggtggacagccatgtcacacctgactcccagtgctcagctcataggtagggagccatccactccaaatcctaaaacctgcttagttagcatagcttactttatctcattaaccccatctagtgaacacgaaagtcatttttatttgtctacatgatgtgctcataatcagccataagtctcttgtaaacaagaacattatactaagtctttagcattttcttcaactcatcagccccattttccaccttccttgaagactacagctttagatgtttgttatgatatgaacacctgactctggacttctgcctggggttttggcgcatctcctatgtttctatccatccctgtttctatttcctgccctagtggcagcatgtcaattctgtttttctctccacacttctctccttctccacaaggagagagaacagttatggatacaggatggactgttcttaaatgtttttacactaaggaaacttctttgtgtttacatgtgctcataagttccattaacactaatagccagatgtttttttgtggaatatgcaggcctctgcattttgtaaggaaaagctggattgtattctcttaaatacattttttctttccttcattttaggctttaaacaaagtagaatagaaagtccttttagataaaatgatattatattatgtgattacagtaaatgcatgtaatgtacaacatttatattcccagcattcttcacatgcctcatataatgaacatcttactacttaaattctcactactaaaattcacagtaggataatcacttactctatatatgtcagggcaaacatgactgagaacttttgcattcaatttggcttgaagtaattcttatttatgaaataaatggaaaaattatctccaaagtaatacatgttctaggagattacataatatttaagagaataagctgattttccattctaacatttttttaactaaaacattgcaatgtagaatttatacaagtcagagacagggctgccttatatacttgacactcagctggacacctgtcctgtgaatttagggaagttcctcacctctctgtgtctcagtttcctctcagtgcacaaataagaatgttatttgtcctgctttatttcacaaaggtgaaaagattacaaacaatgctgtcataaacattttatgcacatttattcatataacaaatatttaatgagcaactactgtggaccaggtattgttctaggtaccaggacactgcagtaaacaaaaataaaccaaaaccctgcctttatgagtgtaagttcatttatctacataaatctacatacataaataagaaaataaatagaatgtacattatgttaatgataagtgctaatgtaaaagaaagtgaaattgggaagggaatacagaataaaggagcaaggaagacctcaatgacagttgacattcaagtaaaaactggaaaggaataagaagatgtctagggtgcaccttaaggaagagcattccaggcagaataaacagccagtgcaaatgcccagaggtagaaatgtgccaggtgtgtcctagaaacaaggaggccagtgtggctaaaacagacgaggaggaaaaatggcagacaacggcatcagggaggtaaccaggagcagaccagagagtgccgtacctccctaagtacatgtgctagtttcttcaggatgtgtacccaggaagtggcactgctgggttgtaagatgggaacatctgcagttttgctagatattgccaaattgctcttaagtgtacattttcacacttttatcagcttttgaattcctgttgtttcacatctttctaattcttgacattttcagacttttaaatttttggacatctgatagatatgaaatggtatctatcacagtttcaaggtatttgttaaatgctttctattgcagtatttgggatatttcctcaaatgctagtgagtttaaagatcttttcatctgcttattggccattccagatttctccttttataaattgtgtttatattctaattttctattacattgtttctttttttcctgttgaagtgaaatttttacatgtcctaaatattcctcctttgttaaacacactattcttcaagcttgtgacttgtctactttgttcctacagtgtttactgatgtattgaagttttacattttaatgtatcaaatttgtttatcttttcctttacagttcatcctttttttcttgagaaatacttccttatatacacaagatattcaccatctctgttgtttctcctgatggcctaacattttagtttttatacttaggaattctgtctccctggaatgatgtgagacagatttttttttctattgggttaaccacctgtctcagtacctccttcctctttagcaaaacacagcgctataatttgttaagctccacatatgtgtttcctggattctttaacctctcttgttggtcaaatttttttctctacaatagtactacatcatcttaattgctatagctttataattagtcttgatagctatgtatacatacacaaatatatattccaaacttgaacaatttggacaagtggatgatttctgccaccctgttcttcaaaattgtcttggttatttctcaatcctttgctcccctatgactattttataatccttgttttcaagtactataggaaaacattttggaatttttattgaaattgcattgaatttaggaatgttaatgtctttatgatatcgagtctacttatttacaaatgtggtatatcttttcatttgtttaggttttttaaaaggtcattcattaaagttttgtaatttttaccatacacttcatgtacagattttgttagatttatttctaggagccatttttgcagttgccacattgtaaagggcacctctttttatatttttatagattgtcactgtttgttcctgatgaataaggaattcaattttttatattgatctaatagccagtaagcttgctgagctcttattaactctaataattttactatagatgctcttgggttttctatgctgtaaaacatatcatctgagaataacaatttcatttcttcctttgtgatgcataaacattatatttctttatctcattttaatccattgactaggcccctccatacaatcttaaagcagagggcattttttgctcatttctaattttaaagggaatgtctaacatttcaccattatgtatgtactataaaagctttttatcaatatatttcacaaacttaataaaattctttctattcctacttcactgagaatttttatcatggatactcaattttatcagatgcctctttgcttttattgagatgctcatacagtcttacttcctaaatttatcaagataaatttaactgtcttgatgcactttctaatggattgctggaattggtttcttaatactttgcaacaattttcttttcaatattccatgttgtttgagaaaaaatatgtattttctaattggtgagtgcaagtctgtgtgtgtgcatgcatgtgtatgtgtgtctccaatagatcaaggctgttaattatgttgttgtaattttctatatccttaatgaatttttgtttccttcgtctatcaattactgacagtatcgtattcagatctccctcaacaattatggatttgtcaatttctcattagcatgtaaattttatctctgaatattttattagacatatacaagttagaaatgttatctctttctagtgaagtgagactttattatggaggtagagaaagaccattttatctctttaactctgaaaatcctttctgccctaaaaactattttacctaataatttaccaacaaaagcttccttatggttgaaacctacccaatgtattgttttgcattttttcctttcaaccttcctgagtccctgtgttttaaatgtgtccctcataagcagactacatttgggtttcctataatccaattactggtttttttttaaatatactttaagatctagggtacatgtgcacaatgtgcaggtttgatacataggtacacttgtgccatgttggtttgctgcacccatcaattcatcatttacattaagtatgtctcctaatgctattcctcccctagccccccacacaccaacaggccccagtgtgtgatgttccccgccctgtgttcaagtgatctcattattcaattcccacctatatgtgagaacatgcagtgtttggttttctgtccttgtgatagtttgctgagaatgatggtttccagcttcatccatgtccctgcaaaggacatgaactcatccttttttatggctgcatagtgttccatggtgtattatgtgccacattttctgtatctagtctatcactgatggacatttgggttcgttccaagtctttgctattgtgaatagtactgcaataaacatacaggtgcatgtgtctttatggtagcatgatttataatcctttgggtatatacccaataattggattactgggtcaaatggcaattcttgttctagatccttgaggaattgccacattgtcttccacaatggttgaacgaatttacactcccaccaacaattaaaagctttcctatttctccatatcctctccagcatatgttgtttcctgactttttaatgattgccattctaactggcatgagatggtatctcagtgtggttttgatttgcatttctctgatgaccagcgataatgagcatttttttcatgtgtctgttggcagcatagatgtcttcttttgagaagtgtctgttcatatccttcgccgacttttggatgggttttgagttctttgtagattctggatattagccctttgtcagatgagtagattgcaaaaattttctcccattctgtaggttgcctcttcactctgatggtagtttcttttgctgtgcagaagctctttagtttaattagatcccatttgtctattttggcttttgttgccattgcttttggtgttttagtcctgaagtccttgcccatgcctatgtcctgaatggtattgcctaggttttcttctagggtttttatggttttaggtctaacatttaagtctttaatccatcttgaattaattttttgtataagatgtaaggaagggatccagtttcagctttctacatatggctagccagttttcccagcaccatttattaagtagagaatcctttccccattgcttgtttttgttaggtttctcaaagatcagatggttgtagatgtgtggtgttatttctgaggcctctgttctgttctattggtctatatatctgttttggtaccagtgccatgccgttttggttactgtagccttgtagtatagtttgaagtcaggtagcgtgatgcctccagctttgttctttttgcttaggattgtcttggcaatgcaggctcttttttggttccacgtgaactttaaagtagttttttccaattctgtgaagaaagtcattggtagcttgatggggatggcattgaatctatgaattactttgggcagtatgaccattttcccaacattgattcttcgtatccatgagcatggaatattcttccatttatttgtatcctcttttatttagttgagcagtggtttctagttctccttgaagaggtcctttacatcccttgtaagttggattcctaggtattttattctctttgaagcaattgtgaatgggagttcactcttgatttggctctctgtctgttaatggtgtgtaggaatgctagtgatttttgcacattgattttgtatcctgagactttgctgaagttgtttatctcttaaggagattttgggctgagacgacggggttttctaaatatacaatcatgtcatctgcaaacagggaaaatatgacttcctcatttcctaactgaataccctttctttctcttgcctgatttccctggccagagcttccaacactatgttgaataggagtggtgagagagggcatccttgtcttgttccggttttcaagggaatgcttccagtttttgcccattcagtatattggctgtgggtttgtcacaaatagctattattttgagatacgtcccatcaatacctagtttattgagagtttttagcatgaagatctgttgaattttgtcaaaggccttttctgcatctattgagataatcatgtcgtttttatcattggttctgtttatatgaaggattacatttattgatttgcatatgttgaaccagccttgcatcccagggatgaagtccacttgattatggtggataagcttttgatgtgctgctggattcggtttgccagtattttattgaggattttcacatcaatgttcatcagggatattgatctaaaattcttttttgttgtgtctctgccaggctttggtatcaggatgatgttggcctcataaaatgagttagggaggattccctctttgtctattgattggaatagtttcagaaggaatggtactagctcctctttgtacctctggtaaaattcggctgtgaatctgtctggtcctggactttttttggttggtaggctattaattattgcctcaatttcagagcctgttattggtctattcagagattcaacttcttcctggtttagtcctggtagggtgtatgtgtcgaggaatttatccatttcttctagattttctagtttatttgtatagaggtgtttctggtattctctgatggtagtttgtatttctgtgggatcggtggtgatatctcctttatcattttttattgcgtctatttgattcttctctcttttcttctttattagtcttgctagcagtctgtcaattttgttgatcttttcaaaaaaccagctcctggattgatttttttgaagggtttttttatgtctctgtctctttcagttctgctctgatcttagttatttcttgccttctgctagcttttgaatgtgtttgctcttctctattccttttaattgtgatgttatggtgtcaattttagatctttcctgctttctcttgtgggcatttagtgctataaatttccctctaaacactgctttagctgtgtcccagagattctggtatgttgtgtctttgttctcattggtttcaaagaacatctttatttctgccttcatttcattatttacccagtcgtcattcaggagcaagttgttaagtttccatgtagttgtgtagttttgagtttcttaatcctgagttctaatttgattgcactgtggtctgagagacagtttgttgtgatttctgttcttttacatttgctgaggaatgctttacttcctattatgtggtcaattttagaataagtgtgatgtggtgctgagaagaatgtatattctgtttatttgggatggagagttctgtaggtatctattaggtctgcttgttgcagagctgagttcaattcctggatatccgtgttaaccttctgtcttgatctgtctgatattgacagtggggtgttaaagtctcccattagtattgtgtgggagtcttagcctctttgtaggtctctaagggcttgctttatgaatctgggtgctcctgtattgggtgcatatatatttaggttagctcttcttgttgaattgatccctttaccattatgtaatggctttgtctcttttgatctttgttggtttaaagtgtgttttatcacagactaggattgcaacctctggtttttttttttttttctttccatttgcttggtagaccttcctccatccttttattttgagcctatgtgcatctttgcatgtgagatgggtctcctgcacacaacacactgatggtcttgactctttatccaatttgccagtctgtgtcttttaattggggcatttagcccatttacatttaaggttaatattgttatatgtgaatttgatcctgtcattatgatgttagctgattattttgctcattaattgatgcagtttcttcatagcatcaatggtctttacaatttggcatgtttttgcagtggctggtaccagttgtttctttccatgtttagtgcttccttcaaggagctcttgtaaggcaggcctggtgatggcaaaatctctcagcatttgcttgtctataaaggattctatttctccttcacttatgaagctttgtttggctggatattaaattctgggttgaaaattcttttaagaatgttgaatattggcccccactctcttctggcttgtagggtttctgctgagagatccactgttagtctgatgggcttccttttgtgggtaactcgatcttcctctctggctgcccttaacactttttccttcatttcatccttgatgaatctgaagattatgtgtcttggggttgctcttctcgaggaatatctttgtggcattctctgtatttcctgaatttgaatattggcctgccttgctaggtttgggaagttctgctggatactatcctgcagagtgtgttccatcttggttccattctcctcatcactttcagataaaccaatcaaatgtagatttggtcttttcatatagtcccatatttcttggaggctttgttcgtttctttttactcttttttctctaaccttgttttctcactttatttcattaatttgatcttcaatcatggataccctttcttccacttgatcaaatcggctattaaagcttgtgcatgcatcacaaagttctcgtgccatggttttcagctccatcaggtcatttaaggtcttctctacactgtttattctagttagccattcatctaatcttttttcaaggtttttagctgccttgcgatgggtttgaacatcctcctttggctcagagaagtttattactaacaaccttctgaagcctacttctgtcaacttgtcaaagtcattctccatccagctttgttccgttgctggcgaggagctgcaatcctttggaggagaagaggcactctggtttttagaattttcagcttttctgctctgatttctccccatctttgtggttttatctacctttggtctttgatgttggtgacccacagatgggtttttgctgtagatgacatttttgttgatgttgatgctattcctttctgttagttttccttctaacagtcaggtccctcagctgcaggtctgttggagtttgttggaggtccactccagacctgtttgcctaggtgtcaccagcagaggcttcagaacagcaaatattgctgcctgatccttcctctggaagcttcgtcccagagggggaactgcctatatgagttgtctgtcagcccctactgggaagtgtctcccagttaggctacacgggggtcagggacccacttgagaagacagtctgtccattctcagagctcaaatgctgtgctgggagaaccactgctctcttcagagctgtcagacaggaatgtttaagtctgcagacattgactgctaccttttgttcggctatgccctgtccacagaggtggagtctagaagcaataggccttattgagctgcagtgggctccacccagttcgagcttcccagccactatgtttacctactaaagccccagcaatggcagacgcccctccccaaccaggctgctgccttgcagtttgatctcagacttgctcagtgaacaaggctctgtgggcatgggacctgccaagacaggcataggagaacatctccttgtctgccagttgctaaaaccttgggaaaagtgcagtatttgggcaggagtgtcccgtttttccaggtagtctgtcacggcttcccttggctaggaaaaggatatcccccaaccccttgtgcttccagggtgaggtgatgccccgccctgctttggctcgccctccatgggctgcacccactgtccaaccagtcccaatgagatgaaccaggtacctcagttggaaatgcagaaatcacccgtcttcttcgtcaatcacgctgcgatctgcagaccggagctgttcctattcagccatcttgcgactgtcttttaactagcaagtttagaccatgtatatttgttataatttttattagagtactatcataatattttgtgctagtttccctgaaattttctatgcttttttcccccacttcttttctcaccatttagattgagttatttttattctatttcttccttttctctacttgcttacttggaaattgcacactgtttctttattatctttttttgagatggggtctcactctgtcacccaggctggagtacagtggcacaatcatggctcactgcagcctcaatttcccaggctcaagcgatcctcctaactcagcctcccaaatagctgggactaccggtgtatgtcaccatgcttggctaattttttaaactttttgtacagacagggtcttgctgtttctcagactgatctgaaactcttaggctcaagtgatcctcccacctcagcctcccacagttctgggattacaggcatgagccactgtgcccagccactgtttttttaattacctttaaaatgtttacttttaaagtcaaagttgatcagtaattctacactcctaaaagctttgatcatcctccttccttttcactttgatttccgatatttttccactatttttccccaccacagattagttaatatcattttgttattgatttttgcaattagtatttgcttatattttacatcatgtattctaattactctgttcattagtctttctcatatttcaatgtgttctaggctcaatttaattttcagaaagaatagcctttggaagttcattcagtaattaactatgataaactcactgatgttttttgccataaaatatatattttcaaaaagctagaaaagaggattttgaatgtttataacataaagaaatgataaatgtttgaggtgatggatatgctaattatcctgatttgattacacatcatatgcacatttcaaaatatcacttcatatcccataaacatgtacaattcttacatgtcaactaaaaattttaaaaagactattatgccatttttattgaataatgggttaacagatattttctcttagcactctgaacacagtcttctgactcatgtttactgtagagaattctgctatcaatctaattgttattcctttgaaataatccatcttttctctgtggctgctcttttgatcttttgtcttctgtgttatgcagttaccctttaatgtatctacctatggatttattgttatttatgtgcttgggatttgttgtgcttaattttgagcctctagtcatttattaattctgcaaaattgtatctttttgaataactctcccacattctctttattttctccatcttatatttccattagcgactttgttaccaccatttgattgtagacaaaagttttagtctaccctttcattgaagtgtgactctcctatgatcctggctttgtgaagaggtcccagtttcaactccccgacttatgcccacctcctgcatgcatctgttgaaacacacacttaggtttactaaccttctgcatgcatctgttgaaacacacacttaggtttactaagataggcaactaacctgagaacagctgcctctatccacttactatttatattttggttctgcctctgtatttcccttatattccggtgatctcaaataaacattggagaaggtgtttcttgcattttatcaacttatctaagtgctttgtagcttaaaggtacacatataaaatctagacttctgtattgccaaaagcagtctatattttttgttataatagttaaatgattcaggcttttccattgtcctggttagatcattaaagaacataattttcattatcctaaggtacgtttcaagtattaaaaaaagtcaggaacttgctcttccctgcttttagctaaatgttaggaacttgctctgccctactttagctaaagattcatttgtcaaatcctcccctgaaccaaaggagaaaataacaaagcaaaacaagacaacaaatcaccaagcaaaggaggaagtgtgggtctcatggaatttacactctgtgctttatcttgcacagttgctgaagttcatctgaggttttaaatggcattaattttgtcaggtaacattttctgagcacccaaatgtgttcactttgctgatgagtgatccatctcaaagtgtgaatatcacaaaattccagagaaaagatgctggttattgtaagaaaattagagaaagtacacctgccttagccttcacatcattgacaactcctttttatgtgtatgaatgaacagcagggtgggagtgatgcaactgtaccacagatttcccgtggactacctgtccacaccattatggaaaatcatcaggcaatttgttctcatgcatgactgcaggtctattcagtgggtggtagcactttttgaatagactcattcaccattttaccttgaaggcagctagaagggagaccaaatttaatccctttgcaggtgattatagcagtcacagttcttcactgtgaaggagcagataaaatgcaggatttgccatagaaaatcctggagtttcccagcaatgcttaacatttttcaaagcaatcaaccagaaaatactgatcatttgagaaagaggtgattgaaacaaaatatttaagcaacttttcatatggataatgcaagcaaaaacaaaagttttatccaatatctagagcagtgcttctcaaagtttaatgggcatttgaatcactgccagcattcttgttaaaatgaaaattctactcatagattgagggacccggttttgggggggtggaagggagtgctgcaaccttaactaatgaactcacaggtgacaatgttgctgttgatgaacctgattttgagtgacaaggtcataaaagactcaggcaaaatgggttatactagaataatctgcatttgagctatccaatacagtagccaccagtcacacatggcaattgtacactcaaaatgtggctaatccagattgcgaggcactataactgtgaagtgcacattgaattttgaagatttacttaagaaaaatatataaaataagccatcttttaatctgactacatgttgaaatattatgggcatattgggttaaacaaaatttattattaaatatatgtcactttatactttagtgtgtttaatgtgactaatagaaaacttaaaattccatatgtggctcaaattttgtttctctattagtttcctattgctgctgtaacaaattactacaaaatcagtgccttaaagcaacataaatttacagtcttacaattagttctagagatcagaaatcctaacatcaaggttcagcagaaaactaagaaagactctttccttactttttccaacttttagaaactacctttattctttggctatggcccctttttccatcttcaaagtcagcagcagcatagtatcttgaagtctctgtctctgtgtctgtctgtctctctctctctctcctacttctattatagtatctccttctcttattctgattctcccttcctcttataagaaccctagtgattaccttgtatccacccaaataatccaggataatctccccatctcaagatccttaatttaatcacatctacaaattccctttgccatgtgaaatagcatattcacaagtttcagggattaggatttggacatcttggcggggattttgtctacttcagtttccattggacaatactgatctacataattcatccattttgcattatgccatacctagctgtgtactctaatcactatacaaatggagtcaggaatatgaaataaagtattttattatttgagtatcgcaatgcaaatacagggttaaaaaagctaaatgtatttttgaatggagtccaatttctgaatagattcaatgtaatataaacaggttttgtggtaagtattgaaaataatgcagaatactggattcactttctaatgtaagacatttttatggccctcaattccttctattaattggtagatgaggggtaatgaatttaaacgattaatgaatataaaggataaagtctgggcagaagagtcaaaatctacttacagcataatgtgcctaaaagacagtgtaactttcagagctgattctcctagtaaattgcttataaatttattgaaaaatattttggggtactcctatatgaagacattcgtgagagctgaaatgtttctggactctagctgctcacaacctagcagcgaaataagacatgaacaccaatggcagatggcccagataggagacaaaaaatatcacctgggtggtggtgatactaaggagttgagaggaaggaataactgcagtgtggcaaggtcttagctcaaaatgatctaggaagattgcttggaaaaagcggactttgacctgcatttttgagaatggaaataaattcaatctggataccttaagaattgagttcaacaattctgtaagtcttctattttgtttaagaggcacattttgtaataaatactgatgttggcagtattgagatttcctctttttttatttcttaaacattaaccttggaagttagatcagtagaggaagcaaaggacacagaaactgagggcaagggaaaaaaatttaaaaaatgaaaattattgcagttttctcaccacatacttcctatcttcaacacaaaataacttgtgttcagatttcagaaatatagccataaaccagcttgtcagtagaatagaaaccggcttattttcaggatactgtaggcacatgctctaacttactatacatttcaaaacatttaagattctgttatggtgtaaatataccacccttgcagaaaatttccatatttataaattatacatagacctacattatccttctgtctatgtattcatccatccatctattaaatatcaactttatcctgagggctctaccaggattctgatttgaggaatctgcagggagcagcctgaaaatccaaggccctattttgtcatggttattaattaagcatgtctaagtgccaggcatttccagagcctgcacagacacagggcctcacactttggttactactggagctcacataggactggacagcaatttctttcaactggaggaagaagcaggtgaggccagtgcatgcgtgaggcatgatcaaggcagacggagagacgtggctgcttcagacaatccagaacagtaactaccatctctttacaagattgaaatgtctcataaaatatttattggatgaaatacagaatttcccacaaatggtagcaaatattttatagcaaaaataaaatgaggctagaaaaaagatgcctgctttcatgaaaattcagtttggtcaagacacagcctcagaagacagtacgtaccctttttcatttttctgagaccagcagaatttggcccccttttcaaagaactgagatacaagttgtaagtgtccagtgctctcacatggcttcaccaatggtttagcattagttggacctctctaagagatggttatcttttctagaatcaaaattagtggcagaaagagaatcaaagccagggttccttcccatgcactttccatgatccatgctaacttctcaggaatgtggaaaaatttagcattcataaggtggcagggcattctgaaaaattgtgtctctttttagaacttcagtctactgctctgaaaaacctgtcttggtgtatgcctcaccccatctttattacccctattttacaagtcacattggaaaataaacagtgttgatagtactttcttgtagataaataataaaatttggggaagacgacttctgcttctgggaatatgaaatagacatgttatccctattcctctctataagtgcaactaaaaatcctaggcattatatataaaacagagaaaataaggcaaaatggctagggacttcaggacccacagaatgacagtgttgagtttcctggattttctgtttgtctcatacatttcagacttggagctgaagaagctggcaaccaaaaaccaccaatgggtgtgggcacagaaaaggctcaacaaaagcttgttctctctagctaaaagaacagcaaacagtagcctataagagaaaacttttagacaataacctttctacttcagcctaatactatgcccacccgcgccagcaaagaccaagtggggagccaaacgcaagggtggtgttagaggaagccaaataagatgcagtaattctcaccctcgctaagaggtaaatagcctcccccatgatatcagaggacaccatgtgaaaagcctgactatccacccctctacagagaaggggagagcagtctaaaatttatatggaaagggaaaggaactcaaatatctaaaaccatttttaaaaggaaagtaaagtctacctgatttcaagactacaagtaaagtctacctgatttcaaatctacagtaatcaggatattgtgatattggcagaagggtaaacatatagatcaatgaatgtgaatctccaattatctcaaaatgaaagttttaatgaaaaaattattctataaacagtataatcacataggtctcattttttctttttatgaagctgtgtctatatagaaaatattgctgaagagttgaggggtcttttccctatacgaaatcttcacaattggagaaataattttagtatataattaaaactgaatcatgagttatatttacataatacttagccttctattttaaaatactttgagtgttatttgtgaagtcaaaatccagatacaaagccaaaattcagtctatgatctagataggttttttttatgttgttggttttttgtttgttgttgggtttttttgtttttgttttgtcttgtttttgagacagggtctcactgttccccaggctgaagtgcagtggtatgatcatagctcactacagcctcagtcttcccggctcaagaaatctcccacctcctgagtagctgggactacaggcttgggccaccatgtctggcttattttttttttatttttaatagaaatgatgtcttactatgttgccagggctggtcttgaattcctggactcaagtgatcctcctgcctcggcctcccaaagtgttaggatgggatgagccaccacacccagccatctgaaggctcggatgattgttagcattttttagcaataaagtattttttttaataattttacttttgccaggcagcctgagtatgtttctaagcaataagtattttgaaattaaagtacgtacattaggttttttaagatataatgctattgcacacttaatagactgcagtataaacataacttttatatgcactgggaaactaaaaaatatatataattagcttaattgtgatatttcttttattgcagtggtctggaaccaaactcaatatctctgaggtatgcctgtaaatataagacacgcaactgaaatatatatatacacacacacacacacacacacacacacacacattcaaaaatatccgttattcttaactcatggaaattaattcaggacaccccactaaatgcaaattagtgttaattaatatagttggtaattgttcttttctgatacaagggcctatattcaattttaatcaataagcacaaaaattggttaactcaattttactcttaatacagtattttgttgatctgtaaatagttcatttatttaaaagcttttgtatcctccagcaacatttctgaaaaaatgatgtaaatttcaacctcaagtatagataatactaatatcaaacacttgtaccacatgttaggatttaaaattaaatttacacaacctatcacatttgaccttctaacaactgcttaactgcaatcatttcacggattttctagggtatgtaagtgacttttctaaggcaacacaaccatgaaacccaacaaagactaactcacatgtcatagcattaagtttagcaacttttccctatcaccaatctgacttcctgtcagtgaatatttgagacccacaaagcagtccaatttattaaatattgctttaactagaaaattatactcctatgattatactgttacaaaagacaatcctattttaaaagaaacgctccactatttattttgacaaggagaatatccgctaaacattatagacatttatttgagatgtgggtttaactgaaatggatagtgtatagtcactttgacttcagctggaaaaggtgcactgtctccaaacccagagcataagaaaacacagaaaactgaaaagaaacatgtgtctgaaaatgacatggtaattgcttcaaaatatgagccactgcttcataatttaagtccctctaaggcctgatatgccttagtcatctttggaaatcagtatctttgagtcaatgaatcttttggctgcttaaccttctccatggtaggaacagtaagtatcataaggcaatgattacgttagttttgtgcatgtttttattcactgcccagttgtcctctcttgctccttggagcatttctgtgtcctcatcatttgcattcttaacatgccaatcggctctttattctctcgctgagtacttattctctgaggtatcccagaaatgcacaattgctcttgtccagcctatagatcaaactccaatctaatttgcaaaaccaagtaaatacaaagtaggttgcacataattcagacctcatcttgcactgattaagctatctgattctagctttcacatttccctcttttcacttaatattctccccactatctcttcacgacaggtacttgccaggtcattttggttctttgagtgctgcttcagcttctctttaaaaacagtcaaaaaacccttttgttatttagaagtctaggggatttgttggctccttcttaatttatgggtaccatcctgatgaggatacactgcggaactccgggtctttaatcttcccgtcttgagacatggacagagtcacatgctattttaaaaggtaatatgtcaagccaattatgtgccctgtggaaaggtttctagtgctatttaacgttatctttcaagaagctcaaatttgtgtttgtaacaaagtactccacaaattcttattcaatgaaagtaaaacacacatacagcagagctaaacagccatcattgtggttaagaagtttaatcaggaacattatcaggaatttttctagccggagttacaggtcaaataccatgctttttactagaggattcctaaactgaagtccaggacagactttaggggcccagcaataccatcaaaacatacgtatcattgtgtaactatgtattagatgagaggttctcagtgtgtggtcccctaaccagcaacatcaatatcacctgggaatttgttagaaatgttagaaactctgggatgggactaccacagcctgtgtttcagtaagccctgatgcatgctgaagtatgggaatcactgctccaaagaaacgatgggtggctttcctaggtagtttgctctcatcccctaccactccctgtctcactcagccctaaccacactgacctccttgtaacaccccaggcattccctgacttgggacctttgcactaacacctcccagacttcaaacacttccctcagatatgtgtgcagccaattcccttaccttctttatatccttgctcaaatgttaccttctcaatgagttctaccccggccaccctattttaaattacaccctgccccaccgcatctaccagcacttctgaccctctctttcctgctttttgtttttctaaaacatgtcacctcctgtatactagataattgacttctgtattatggtttttgcttgtctaactccctgcctctcagaatattaactccacaagggcaacaatctttgctttgttctgagtgcctggaataacatttaacacagagtaggtactcactaagtaattattaaatcagtgaatgaatactcaaaggaatccatgaccttaaaagggataaaaacactattccagagacaacttggtaattttctttcacaggagattcgtttcttagagccaattctcctaccattattttcctgttgttccattttcatgttgttccatgtgctacttggaaggatggagataaaaggtagagaaaatgttcaagaatgatgttgggcagaagttagaactgtttgtgtaaactccctgtttaattgtatttttgcctttcaggttgtgatttctgagtttttcaaataaatacatattaactaatttaattctcctaagaaacttattacatagcacacttatccatcttttataaatgaggaatgggggcacagaaagattaatatttgcccaggttcacacagaaagtatatgaaagagatagaacttgaattagcaatctgaccctatagtataactcttaacagctatactatatctaataaaaccatttcaaaattaataagtcttacctatgttttagcatttagaatgttttatcataattttaatagttatatcttccctgctaggctggaaaaaaatttttaaaggggaatcctttcttgttcatcatccctacctacctagtgcctagcataatattattggatggatggatgaatggatggatggatggatggagaagaatgtaagtttcaggctggctgttacattcagctctaagataactaaacagtcccttgaaactccagaaataaattaataagctttggtttttcctcaacttaaatctgctagataagcctgaggatttgcaattggaaaaaaaaaaatgtgtaagggatcagataagggaaactgaatgataaggacattcgtccctaggtggttttggccacagggatgtctatttctccagctgtcctgctgccttccccaaaagataaagagcagcaccagcaggggagcaaaggttgctgggctatgtccccttcctctaggtttgaagctggaaggatgaaccagctttgcctcagtgactggacccttattttcatatgcagtcaggacccaacaataaaagcaaatttttaaaaacgctatgcttagaattgaaagaatgcagaaagaatgcaaattgcctttacagctgcctgaccatcctagtgaatcctttaaccctattctttcctcctgcttctgtctcattgtattaaatgctgtatccagaaaacattttcttaatatttaaacgtagcatcttacaaatggatggcatcacagcagatccctgaggatgctataaggctcagcctccgtgtcacccaggatgattttaacttgcttatctcatttcctgcctctgcccctgggttggctagaaaaaggaaagatccaatttccatgctaggcctgaggatggtccagggcttttctctgcagaccccatggctgctgccctctgctggaatgatgaggcctgaagtccttccatcacagattccaagtgttccttttaaaatactttagcagctcttgtcaaaataaacaaagcggcccaactaaaggttccatggcaattaggaaatttacttggcagcaggtaactttagaaaggtagttatttatcctcattagggctatcatatacgtgtcagcagagagaggaagcttctctccacacctgggaaatctaaaactgcacgtgctgtttgtttctaagtctctggctgctgaatgccagtccaagggcagatgccactcagactccatcagaaccacctgggaagcttttccaaaatactgactcctgggtctagtgatagacagtctgattcattaactaagagataaaacctggaaagcagttcgtaatttttaagagctcctcatgtgattctgatgcacaatcaagtttaagagttactagcaagacttttgaattatgtatcatcttgaaatacaattttcttttaaacgaaagtatctttattatttattatgaaatgttttattctcatgttaacacttcaaaaatgtagaacaagatgaataaaaaactaaacaattgctttaaaaaaaaaaaagacttattacccagaggcaatcactgctaacattttggagaaatttttccagacatttgacgtgaatacataacttttttatttttattatactttaagttctagggtacacgtgcacaacgtgcaggtttgttacatatgtatacatgtgccatgttggtgtgctgcaccccttaactcataatttacattaggtatatctcctaatgctatccctcccccctttccccaccccacaacaggacccagtgtgtaatgttccccttccggtgtccaagtgttctcattgttcaattcccacctgtgagtgagaacatgtggtgtttggttttttgtccctgtgttagttgctgagaatgatggtttccagcttcatccatgtccctacaaaggacatgaactcatccttttttatggctgcatagtattccatggtgtatatgtgccacattttcttaacccagtctatcattgatggacatttgggttggttccaagtctttgctattgtgaatagttccacaataaacatacgtgtgcatgtgtctttatagcagcatgatttataatcctttgggtatatacccagtaattggatggctgggtcaaatggtatttctagttctagatccctgagaaatcaccacactgtcttccacaatggttgaaccagtttacagtaccaccaacagtgtagaagtgttcctatttctccacatcctctccagcacctgttgtttccttactttttaatgatcaccattctaactggtgtaagatggtatctcattgtgattttgatttgcatttctctgatggccagtgatgatgagcattttttcatgtgtctgttggctgcataaatgtcttcttctgagaagtgtatgttcatatcctttgcccacttttgaatgaggttgttttttttcttgtaaatttatttgagttctttgtagattctggtattagccctttgtcaaatgagtagattgcaaaaattttctcccattctgtaggttgccagttcactctgatggtagtttcttttgctgtgcagaagctctttagtttaattagatcccatttgtcaattttggctttgttgccattgcttttgctgttttagacatgaagtccttgcccatgcctatgtcctgaatggtattgactaggttttcttctagggtttttatggttttaggtctgacatttaagtctttaatccatcttgaattaatttttgtataaggtgtaaggaagagatccagtttcagctttctacatatggctagccagttttcccagcaccatttgttgaatagggaatcctttccccatttcttgtttttgtcaggtttgtcaaagatcatatagttgtagatgtgtggcattatttctgagggctctgttctgttccattggtctatatctgttttggtaccagtaccatgctgttttggttactgtagccttgtagtagagtttgaagtcaggtagcgtgatgcctccagctttgttcttttggcttaggattgtcttggcaatgtgggctcttttttggttgcatatgaaatttaaagtagtttttttccaattctgtgaaggaagtcattggtagcttggtggggatggtactgaatctataaattaccttgggcagtatggccatttttcacaacattgattcttcctacccatgagcatggaatgttcttccattcatttgtgtcctgttttatttcgctgagcagtggtttgtggttttccttgaagaggtccttcacatcccttgtaagttggattcctaggtattttattctctttgaagcaattgtggatgcgagttcactcatgatttggctgtttgtctgttattggtggataagaacgcttgtgatttttgcacattgattttgtatcctgagactttgctgaagttgcttatcagcttaaggagattttgggctgagacgatggggttttctagatatacagtcatgtcatttgcaaacagggacaatttgacttcctcttttcctaactgaataccctttatttctttctcctgcctgattgccctggccagaacttccaacactatgttgaataggggtggtgagagaggacatccctgtcttgtgccagttttcaaagggaatgcttccagtttttgcccattcagtatgatattggctgtggtataattttaaatagatgtctatttccttagctaaactttacacatgtgtactaagcgttctgttaaccaagagtatggattctgaggacaggctttggcagaaatttcatgacaaaattagaaattgtataaaagcctccataggacctgatacaaaagggactatactgtgaagaaatgtttatgtttactgagcaatattctgtctcattagatgtcagaatttttcaagttagtgctagcccaaatatcaacaagtgaaccaaaaaaccttcaagtatgtatacaagagtctgagaaaggaagaaaatgaaggcaagtgttaggaaaaagtatgagcaagtgagagagtagggtggctagataaaatacagatttcaaatttaatttcacataaataattttttaatatatgtcccaatttatctgaaattcaagtttagttaggaatcctgtgcttttctttgctaaatctcgcagccctgggaggaggggccccatgctttgctgaaaagtgttggctcagggtagaagaagagggtgggcagatacatgaccagactgcaggtcaggaacaaggtcaaggcaaaggttcaccagctctgacgtgtctcagaatctggcacagctctgccacatttcaaagtcaaaccctaacccaccccagcccagcgcattaaagaaccaaaccagtagagcttttcattcacctaaagcagtcacagtcccagcactttcagaggcgaaggtgggaggaacacttgaggtcaggagttcgagaccagcctggccaacatggtgaaaccccatttctgctaaaaatacaaaaattagccgggcacagtggcgcacacctgtagtcccagctacttgggaagctgatgcagaagaatcgcttgaacccaggagacaggggttgcagtgagctgaaattgtgccactgcactccagcctgggcaacaaagcgagacaccatcttgaaaaaaataaataaaaataaagcagtcctggtccttacctgcactcaactccatctctatgcatggtgtgttaaatccctctccctgtgtagccttttcagctgcatatctcaatcagctgaaaaaagtgtttagctcaggaaagtttcctgtaatgatgactttgattactcttttatttctaactcttccagtttacttgtaaacatagagatttaggttggagttccatttattgtcctctgtgtttacagttttctcaacctcatttttatttgtctttcctttcttctgcatcctggggaagcttcctaagtttgtccaggacttgattttatcatttgaactcagatgttgatgtcttcaatatgaatttttattccacctcccattcttactttccttgcatacttggcttcttttactcatagccctttttaaccctcatcctgttttcttttaaaacaaagcctctccttatggtttctgctcttgtttgttagaggatataactttttgcaccctagtaaagacccccaaatgatattctgaactttcggattcctagagcctgacctagtatttgccaatagaaattgagcatgttttctaaatatatagtcatgtcatctacaaacagacaatatgacttcctctcttcctatttgaataccctttatttctttctcttgcctgattgccctggccagaacttccaacactatgtttttacactgctggtgggagtgtaaattagttcagccattgtggaatacagtgtggcgattcctcaaggatctagaatcagaaataccatttgacccagcaatcccattactgggtatataaccaaaggattataaatcatgctactataaagacacatgcacacatatgcttattgcagcactatttacaatagaaaagacatggaagcaacccaaatgcccatcaatgatagactggatacagaaaatgtggcacatatatgccatggaatactatgcagccataaaaaagaatgggtttgtgtccttttccgggacatggatgaatctgaaagccatcattctcagcaaactagcacaggaacagaaaaccaaacaccacatgttctcactcataagtgggaggtgaacaatgagaacacatgaacacagggaggggaacatcacacaccaaggcctgtcggggggttggggtcaaggggagggagagcattaggacaaatacctaatgcatacaggccttaaaacatagatgaagggttgagaggtgcagcaaaccaccatggcacatgtatacctgtgtaacaaacttgcactttctgcacatgtatccccgaacttaaaataaaaaaaattaaaattaaaactaaaaaatgtggagggccctcaaaaaaagaagaccctcaaaaaaaaaaaaagaaagaaagaaagaaattgagtgtggattatctttggcccagcttgcttttagtctgcttggggtctggtcaaatccctttctcacatctgcagcaaacacaagttgaagtactcagctgctatcccagagaccttaaaacagaattgttgccttgtatgggttctactgaactgaaatgggatctttttatccctcatttcccattcttttttgacttgaacagaagggatccatgaaaatctgtaatctccaaggtgttgtgctgccaaggctctccttccttctctgctttattggggaaagtacctctgaacgtacatttgccacaatttttccccacttcctattcaaataataattctatcctgcagtataaattatagattggataagccttccaaacttcttaacacaccataaggccttttcacagctggatttttttccttccttccccatcctgtccttacaatctctaccatgtgtcccctaccctgcagtaacaccaaacctctcctttctgtgaacacatcgggccccttcctgccaccttgtctttgcacatgctcttcctctctgtgcatgccctctgcttgcctgtagttggaggactccttcacatcttgcagtacccaagtccaatgtttctttctctgtgaaatcttttcctgctcccccagcagtttatggctccctctactttgttcatataacactgtgtacagacaactcctcataacacaagtcacggcctgttgtccttgtgcaatgcacaatacacactcgattaaatgaagagaaaggaaacaataggcctgtgcttgagggtgggatcctgctcatctaagtagcaaaaatagtctctactggcccctctgctcttccagagtggaagatcttgcctaaccttataaaaataaaaacagatgacacaaattaacagttatcgagcatctgttatgcagaaagctctgccctggagtagggagagggaggtccaaattctatcactttttaattgtgtgccctccaacaacatttttaccttctgtgagttccagtttcctcatctgcaggatgagagtagaaatctccttacacaattgttgtgataatttaaaaagacactattttagggcttgtagaagagatcctggcacttagtaaatatttaataaaaattagccattaatcagttagagaaaacaaattcaatatacaagagtaggtacttaagtggaatcagagacaggcctttagcccaactctggagttgaggaatgacacacccgaggagcctcagagaagcacccctcctgaacaggctgccctctttatgggtacctcatcctaacccagcctgactggaggactcatctggtttaggccccacttggaggaggtctgctgcaccaacccagaatatcacagtccctgagagcaagagtggggattctggaagaagctgcctccatcatcaagcagccatgtgaacctaagaaagtagcccaacctctctgcgcctccatggcctcatctgtaatgccccttctggtgagagatagtggagtgatgagaagtcctcaagaggctgccctctaaagatcagctgacccaatgtaaagcaaagataaatgaggtctctcctggacagaaggaacctgactctcccgctgccacccattgtagaagaagagatctgaagaagaagaagaagaagaaggggaccatgtttggaatgctgggcccttctcaacaagtgtccaaatggaaaaagcagacaggttgtattagagaatttgcatagatcatgctactgcaaatgctgtttaattctttctaaaatgtttctttctgaagtagtgtagggcaaaagccccctggctgcatccagagctcctggctcagctagggagatgtgattctctcctgattgcctctgtgatcacctctgctactggccccatccctcacctgcacagagtagaaaacaccaagattattcacaaattcactctggagctgctcacagcattgctgtctgctaactcccggtttcccctgtgtagggaaaggaaccttgacacatttccagaaggcaacagatgcccaggatgcagctgcctttatctctttgtcaaagtatggctagatcaattcactagcttcctgtgtttacaaggcggaagaaatggcaacttggtgaaaaaggaaagtggccagacaaaagctggaggccagcattgatggctgggaaattaattaacaagagaaaatcagcaagtaatttttcttgagcaaatgtgctttgtctttgagcttttttttaaatgttatgttagttggttaattgccttcggacactgagtgacaataagacatgtttgcctgttaagataaagtaaagtcaattgaaggaagttagtaatgaaaatattggactcagtccattccaggtaacatatgacacttgaaattacagccacagtgactcctaaatttgcacataatgtctaaaagcttggcttccactaaaccagccatcagttatccagggttctgtacccatcacaaatgatgcaggaatctataaaccatcaatctcaaacatcactggaatacagaaagcgatggtgctcatctctagaaaatccattaataacatcttcagcatagagacaagcctattgtttctatatttaactataattttatttctgaatataaactcagatggctgggtacattcatttctaaaatatatttaccccaaatacacaaattgttcagtctgctaagtccttcaatgatggaaacagtgcccaaataaagcaggaagcctggttgttcacttaattgactattgttttgttggatctgtagagatgaaaactgggaaggatgtcaggtctccaaccctgtgtagacccagagcctaattctcttaaaatgccccaaatcccccaatttctaaagagctctttggccagaatctgtcataaattcaagggaaagactgcaatcacccagcgagtgacaaagcagatgagattcaattagtcactgactgaggcatgttctgctagtggtgagaattgcatgctgtgagaacatctataaagactggtccagggagggcagaccccacactgctgattatatgtgcttctgctagcaaacacagagcaactctcatgcctactgagcccctgcttctccaactgtcctcaaaacagaggaacaggtatctatagctatcaaatcaaggaattggagcaggagggcctatttaactgtccagagatgttctctaatcattcagtgaaggttattcctgcttcaatggtgaaggaggagaaccagcagcagccagggaagggaaggggaggtggggggtgaaatgacaagatcaagggagtgggtgccatggaggctaggaaaggatataaaagaggagacccaagaacatggggaagtagatgaccaaggcctgcctctgaagaggtctctgcccttcaggagccatgcaaaccttgatcccaaaacacaagacaatggtcagagttccaccatcagacacatggtcaacagtacccttgagatgaaaactagatttttaagactagatatgattcccctaaatcaccactatttaaaaaaagaataccagaacttaaacataaaaagataaactgctttgctcctagcctaaagaggaatatttatgagtacttttgtagtaaggttggcatctaccatgaaaatgcatggctttcatttgttgttcactaaactgaactcatctgtcctcagaacgaaccaaacaacacaactgagaattcaggaacccagataggtttcatggcagagtagaaatgagccctaggccaaggacttcatgacaaaaacaccaaaagcaatggcaacaaaagccaaaatcgacaaatgggatctaattaaactaaagagcttctgcacagcaaaagaaactaccatcagaatgaacaggcaacctacagaatgggagaaattttttacaatctacccatctgacaaagggctaatatccagaatctacaaagaacttaaatttacaagaaaaaatcaaacaaccccatccaaaagtgggcaaaggatatgaacagacacttctcaaaagaagacatttatgcagccaacagacacatggaaaaatgctcaccatcactggccatcagagaaatgcatatcaaaaccacaatgagataacatctcacaccagttagaatggtgatcattaaaaagtcagaaaacaacaggtgctggagaggatgtggagaaataggaacacttttacattgttggtggaactgtaaactagttcaaccattgtagaagagagtgtggcgattcctcaaggttctagaactagaaataccctttgacccagccatcctattactaggcatatacccaaaggattataaatcatgctgctataaagacacatgcacacgtatgtttattgtggcactattcacaatagcaaagacttggaaccaacccaaatgtccatcaatgatagactggattaagaaaatgtggcaaatatgcaccatggaatactatgcagccataaaaaaggatgagttcatgtcctttgtagagacatgaatgaagctggaaaccatcactccgagcaaactatcacaaggacagaaaaccaaacactgcaggttctcacttataggtgggaactgaacaatgagaacacttggacacaggatggggaacatcacacactgggggtgtcatggggtgggtggaggggggagggatagcattaggagatatacctaatgtaaatgacgagttaacaggtgcaacacaccaacatggcacatgtatacatatgtaacaaacctgcatgttgtgcacatgtgccctagaacttaaagtataataataaaaataaataaagcagaacaaaagcatctttaaaaaaaaaaaaagaaatgagccctaggcttgaattacagaacttgaatttaaatcttgataagtcattttctaaacaactgtgacttctcttaccaccatcaactcagtttcctactccagaaaatgggggaaacaaacagcccagggcatgcataccatataaattgattgtgaaaatcaaatggcataaggttgtaaaatatgaaatatggaaactataaactaattatatagatattttttatttgtacaaacttatggggtacatgtgaaattttgtaatgtatatataatatgtaatgataaattgaggctatttagggtgtccatcacctgagtacaatacatttttgttaagtatagtcaccctactctgctattagacactgaatttatgtattctttcttacataggtttgtaccctttaactcatttctattcatgttccccccacctcccaggcatcctgtccactatctttccactttttacctacatgtgatcaagtttttagctcccacatgtaagtgagaacatgtgatatttgcatttttggacctggcttatttcacttaagataatgaccaccagttcctgcatgttgctgcaaatgacatgatttccttttttttaaaaaacaggctgaataatattccattgtgtatatataccacattttatccattcacgcattgatggaaatttagggtgtttccatatctttgcttttgtgaagagtactgcaataaacacgaaagtgcaatatccctttgatacattgatttcttttcctttgggttgatactcagtaatgagattgctggattgaatgtgtattagctcgttttcacactgtgaaagatactacccatgactgggtaatttataaacaaaagaggtttcatggactgtttctcatggctggaaaggcctcagtaaacttacaatcatggtggaagggaaagcaggcaccttcttcacaggagggcagaagagagaatagtgagcataggggaaactgccctttataaaaccaccagatctggtgagactcactcactatcacaagaacagcatggggaaaactgaccccatgatccaatcacctcccacaaggtcccttcctctatgcctggggattacaatttggattacaatttaagatgagatttgggtggggacacagagtcaaaccatattctgcccctggcctctcccaaatcttatgtccgtttcacatttcagaaatcaaacatgccttcccaacagtcccccaaagtcttaactcattccattattaacccaaaagtccaagtccaaagtctcatctgaggcaaggcaagtcccttccacctatgaacctgtaatatcaaaagcaagttagttacctccaagatacaatgggtgtgcaggcattggataaatgctcctgttccaaatgggagaagttggccaaaacaaaggggctattggctccatgcatatccacaatccagtgggacagtcattaaatcttaaagctcaaaaatgatctcctttgactccatgtctcacatccaggacacctaatgtaagaagtgggctcccacagccttggagagctctgcttctgtgattttagcaggtacagcccctgcacctgccttcacagactggtgttgagtgcctgcagctcttccagggacaaggtgcaagatatcagtggatctacctgttaaaagttcagctgaattaaattgaaaggagtttcattaagcaataaatgattcatgaatcaggcagccccagaatcacagcagattcagagagactccagcactgccatgtagtgaaagatttactagatctctttagatcttgtaatatatgctttatgaatctggatgctccagtgttgggtcttatatatttagaattgttatatccttttcctggattgctttttcattatataatgacatgattacagaaggaaatgacattctttgcttttttttactcttcttgacttaaagtctattttatgtaatgtaagtatagccactcctatttgcttttggtttctatttgagtaaaatatcttatcctattcctttactttcagtctataggtgactttattgaaaagatgaggggtttttgtttcttagtccattcagccattctatatcttttaagtggagaatttaattcttctacattcaaggttattattgatatgtgaggctttgtttctttaatattgttgttttctggttgttttatatactcactttaaacttttatttcaataggtttttggggaacaagtggtttggttacatgaataagttctttagtggtgatttctgagattttggtgcacccatcattcaagcagtgtacactgtacccaatgtggtggtgttttatccctcacccacctcctgccctttccccaaagtccccaaagtatcattcttatgcctttgcaccctcatagcttagctcccatttatgactgagaacatgcaatgtttggttttccattcctgagttatattacttagaataagggtctccaattccatgtacgttgcttcaaatgccattattttgttcctttttgtgactgagaagtattccatgctatgtatatataccatattttctttttccactcattgggaaatttgggctggtttcgtatttttgcagtgcaaattgtgcttctatcaacatgcatatgtaagtatctcttaatcttattgtcattgcggtctggtggattttagtactggtactgtttgaggctttctcatccttctttgtgtgattgtttcatcagcgagttttatgctttcatgtgttttcatgatggtagatgtctcctttcacttccagtgtaggactccttaagcagttcttgcagggtcagtctattggtaacaaatttccttagcattttcttgtctggaagactatttctccttcatttatgaaggataattttgctggagatagtatccttggttgatagctgttttccttcagttctttgaatatatcatcccattctcttctggcctgtaagatttctgctgagaaatctgtggttagtctgatgaggtttcctttataggtgactaggcacctttttcatgttgtttttaggactcacattttgtctttgactttagggattctgattataacataccatagagaagaccttcttgcattgtatctacctggggattgttgaaccttctgtatatgaatgtctaattctctgaccaaatgtaagttttcatctatttcatattgtctaatcctttaatttgctgttttcagggatactgataacttgtatattcagatgctttacattgtccaacttgtcatgcaggctttgctcatactttttcatcattttttgtccagatgggttgttttcaaaagacctgtcttcaagttctgagattctttcttctacatggtctagcatattgttgaagctttcaaatgtattttgcatttccttcaatgaattcttcagttctaaaaactctggtttatttaacaaaatatttatcactttagtaaatttctcatatccccaattttttgtatttttttcagaattcttttgtatctcactaagcttatttaaaaatcaatattctgaattctttattgggaattttaacattttctttttaagatttattgctgaagaattattgtttctttgaaggtgtcatatttccttgcttttttcacatttcctgtgctcttacattgacatctgcacatctggtttaacaatcacatctcctatttctgaatttacttaggaaaggacatttttctgaagatatatctgtgatgttggttgggtagggccctttggctttgattctgggtgcatgcagtagtatattctctgcatggtttatttaactataaatagtattagtgctttctgtgatttcctcaaagggttagtgtgtggctattagtgatgaagttgtgctgaagcctggaaagccaggtgggccagtctttgggtcccaagagtagcagtggtggtctgaccatacctgtctttgtgccccagggtggtgtacactggcatttgtgtaggaagctaccagtgggatgattcttgagcctccaagtgtcttgctccaggtgccttgctcatctgcccagcagtgggcccacttgggtctctgggcagcctgcatggtgtgggtgatagcagtagcagtggtgggactaccctctgggtcttgagtggtatgggctggtattgacagtagctgtggtatggaatcacccccaacaacccccccatacactattatcagtcttttctgctctctatggaagcagcaacacagcaccacacagaaggggagagaagccctgctttagcatgaagtctcagcacagagaccatactgccagttaggttgtagttgttactcaccacctcagacaggtagccctccggcccacccaccctagcctttgttggcagtaggatcaggtatgcagagggggaggaggggtcatattctctatatgagagcttaagcacagaggctgctctgccagtggcaaaggatgtcactcttcatttgcaaagctggagcaccagagtttgtgctgctgctgaggatggagtcatttcccacagccccagacagggagttcttgggctctggaaagcaaacactttggttttctttttcccaggagatgccttttggtgcattgcactgtccttttcccacagtgtagtactccctgtggactagagtactggggactttgcagcacctttggctctagccagtggtatgctgctgcagacctccaagtggtcactgggtaatgtcagcaaaagctcctgggatggggagatacaagggctattgttccgagagcagaatgctattcctgttggctgtgctccaaaagtgtactctgccatacccgtttaggtctcataggggagggtgagtaacccagaacaagttccttgtctggttcaataacctcatagggtttccaaattgccacccatctggtatcagggattcatgtggatagaggagctctcccatggttcacatcgcagcagtctatggtagaaatatggactgctgaagccctctcacttaatcttttctttcccctcaataccacgttcctctaggctcctggctgatcttggctgagctggccacttgtttcgttctcatctgtacatcaggtgtttcccacgagttttttgttggactctagtgttctctcctagatgttctatttgaggtgtgatagtctgtaattttggctcttctttctggagacagcaggtgcctgatgtctctagtcagccatcttgaaccagaatccagatcttatttaaaatttaaaagaaaacatcaggccgggccaggcatggtggctcatacttgtaatcccagcactttgggaggccaaggcaagtggatcacgaggtcaggagttcgagaccagcctggccaacatagtaaaaccccgtctctactaaaaatacaaaaaatagctgggtgtggtggcaggcacctgtaatcccagctactcgggaggctgaggcaggagaattgcttgatcctgggaggcagaggttacagtgagccaagattgcaccactgcactctagcctgggcgacagagctagaatccatctcaaaaaaaaaaaagaaagaaacaaacaaacaaaacatcagcccaaggtttggattttctgaaaatacaggaataaacaagccaaaattattttcctatactctcactcaacaatcaacacagaagacttctgtgaccaaatgtgtggggtatttttccccacaccaagcaagcaacacttccacagataccacctgggtgttccccgattcaactctgacactctccacctggagatagcatgatatctcacagaatgagggctcaatgccataagattgtcccccactttcaatgccaattataagccccagggatttttttacctgtgcttctgactgactggctgtaaatcagagtccttacaaaatgctatccttgggttcagtttatttgctggagtagctcacagaattcaaagaaacacttacacttatccatttattataaagggtattacaaaaaaacacaagtacagatttaaaaaatgcataggatgagttacgggggaaacgacacagagcttccttccatgccttccctaggtatgccaccctccaggaacttccatgtatttggctatcagaagctcactgaaccctgtccttttgaaggatttatggaagcttcattacatagacatgattgattaaatcactggctattggtgatcagcttaaccttcaaactctcttccctacctggaggttggtggcggggtgaggctgaaagtcccaactctctaatcctgccttgttgtttccagtgacaagcctccatcctgaagctatctaggggctgccagccatcagtgaactcattaacatacaaaatgacacataactttgaatgttttaaggattttagagtgctatgccaggaaactggggaggaagactaaatatatattttgcagtatcaatgattaggaaaagtatcctgttttaaggaatttcctgattattgaattatttctaaccctatccaatacctatagtcttaagtcttaatccattttctgttgctgtaactgaatacctaggattgggtaatttataaagaaaagaaatttattttttaccattcttaagactgggaagttcaacatctaggggctgtatctggtgagaggcttatagctggtgagtacctgcagagtcctgagggagcacaggacatcacatggtaaggggctcacaaggatggctaaactgtcttttataacagacccactcttgccatcactaacccactcccttgataacccattaagccatgaatcgatgaatgagccctcataaccgaatcacctcctaaaggtcttttcaacactgctgcattggagatcaacttttcaatacatgaacttttgggggacacattcaagctatagcaccccatgatctagtacagggttgaaggagaaaaattcacccaaaatgtaaatgtaactgtgactcattttttggcaattttccagaggcatttgagtgaaacgtaagaataaaccaacatccatctttgtcttttctgtgctgtgtgcctatccccaatttcctaatgaagtcataagcagcctgagaattccaggcacattctttgatgacgattattgtatcttcccttgagtaagtctgcagacccaagagaatcatttagatgaatttggctcacgtctccctctccttgctgtctcctcatgccaagaacttggtcacaagtgggcaaagcatgatacgggtgaccacagtgagatcgctcacttaactggcattgctgagtggcttctctgtgccaggcactgtgccaggggctggaaatactgagataagtgaaggcagatgacagtggcctgccccagctcattcacagcttactagggaagttattcaagtaaaccagcaattgagggtcactgtgacctttccactatgaactaaaaacaggcaaataaatcagatctacatttgaagttgtttcaatatctaaacacaatttaaaggtaaaaatttcagactttgtcagcacattttgcctatgttattgacagttcatgtgtttctcataagaatatttggcatgacatgtatctgacaggtaatcagagtttttacatttaaaatgtttcatgaagtcacttgaacatagtacagacacagcccaagaaactaatttctcatagatgatcagccataacctcacgccactaaaatgaccaaattgtgaaacaagcagcagctactaattgacccaggaaattttcaatgacatttgctaacagagctactgacttaatttgaaatattacttttcttctaccagagaaaaataatcaagggacgtgagatgaacaaaacatgcacctacagggctgatccaaaatgacaagtaggaaagcccaagctagaagagttgaaatttagatgaggctgaaacctgtagttcataatcagagacaagatttaaaagggcgaagcattagaaggagggtgggctaggaaataataaatgtagggcttcagggagcatatctttttgacaagaatgttaatcatatatgttactaatctgccaaattaaatttcacagtgccacatgcacagacaggcattataatactggcaaaaatgaattaaaatcccagtaattaatttatgggtttgaactggttttgaactcctgagtgaactcagtgctgggaaataattgaggcttagatcgtggacttttagaattggaaagaaatgtagagatcttcctgaccaatcctatcaccttctacgataggaaactgagtatctgaggggttaagggacttaggcaaggtcacccagatagttaatggcagtggcagttctaaaaaacagtctgctcttgaggacacacataaaattttgacatgtcagtatatgaaatgccagctgacctaaaaatgcaatcaaatgggaagaaaaaaacagctacgttaaagtttgagatagtacagataatcaaactgatgaatcaaagttaaggcttatttaaataattaattagaatcctttaattgaggataacaattcttgtcaactctgatcatataaagaaattacctcaagtgagtgggtagctacaggatctcagcggggacaacctagagcagtctacctcctaaggtattggagactcactctcctggaaaaacaataagagtaattccaccccacgtccctaccacaggcttgtgagaaactcagatacaggaactacctcacaggactctgcggcagaaatcttaaatctacactacagctgcctcacatagcagaaagcactcgaactgtgacatctagggcagagtgttcttacatgaatctccccaggtagttctgttcataaaatactgcagaattggcagtctctgcaaatgtctttctgggggaattgattcataagcatagagtccagtggtccctcaacgttcagattttacggactagtacattttcaaataaattcacagcactcactggtagctttttactttgccaagcaagaacattttttaagtatacatttatatcataaaagaaggatcattttcacctcaaaaaagtgggaaggagatgtataataaaaaaaaatacagtaccaattcaacttaatgaaaatctatattgcccttctttttaaagtttcatttcatactggaccagtgaaacctttgtcagggttatctccaaccagcccacagacagcatttggaaatcatgatcttactgcatcagaaaatatctaccaccacaaacatttattcagaatatctactaatagctttaagaaacagattccaaccaagatagtttgagaaattttagtgaaggggctacttaagaggtatgggcagagttcaaggaataagaaggatggcaggacacccatggtaaacatgggccagaagctgttaccacccaggcctgagggactcgaggaggaagcaggctagccaggagagttgaaacgaccagataaacaatataatcatgcgataatacagttatctgcagaaaacactacccagggtagggaaggaacagaaaaggtgtatcttgacttctcctgtcctccagattcctgctagaccttccattggctgaatccaactggaagccaggggatgagagcccagataatgtgacccacaagtgcttaacctcctgggcctaaagcaaagtgaagaaggatggatctggtgacaggaggaaggagtggaaaggagaagactcacacaaaacaaataatttcagaattatagtagatggtcattctacttttgaacacttcagttcttagaaacttaaaacccttttcacgggctaaactgcaaaagaacagtcttgagaatgttttcatacgcccacccttcttatactaccattttctttctagtgccattttcctattgaagagttcagtgctgatatatgaattaaattctatatacacatacactttgctctctaaaactttcttgtcctgaataagtttgggatttactaccattagtcattcagttccaataattgtttacacaccttatcttcttgatttttttcttaaatcatatataacaatctggcagaatttttttttgcttaaaactgcacctaattttagctacttctgttgaggaaggaggtaggtagcatatttatatcagtagaaagctaaattccaaaattataacagagatcgataagggagggataaagaagacattcaactgtttaagcctctgtcagttgttcttgctggtaaaatgagggggccctttctttctctaagaacattaatgaggctctgggtatccaagggagaaccagggccacagagaatggctgcaaaacctagcagcacaaaaatatgaaagaaactgagttttcagaggttgtcaagagtcagaaaacaggaggaaagaggtaggaaacctaagcgtaggaggactgagcaacatgaggtgcagccggagcttgaagagaacaggagccccctgtgaggtagctgggacagagggttgtgaagaatgagggatatctgatgtcaagtggttttgtgttccataatgtaatgctttctccatagactcaaacttcagtcaagtttgacatacatataaatgtcttatatggatggtctgagggaaggaaaaaaagctgagtgccacttgtggcttagcatgaagcacgggaagtcggcagtgtgggaggagagcccctagcacaattgagattccagaggcagtggaccctgggagctgtgagggaccaagagaacatgagccacaggaattcacaggactattggggaagccattgggctgccctcagaaagtcagatgtgggctcaaggcaaagttatttaaagctcagcaagacaatgtgatcgttatggacatctgagttaaacactaaattccagaaagccatgatgatgtatctgctattggtcaaggagacctcagtgattcaacttgctaactttatggaattaaagtaaaatctcaattcacagattgagaggttcatgctatctccaatactgatactccacattttataagcatatcgcttaatatgtatattctcagaaattagtctcaaaatatatacatgaaaattgtcatgagtaaaaagaaaaagtgacatattgcattctttactaggccacaaactattacaatttttggactaggacagttactgttttgctgcacacaacactgtccgtctgttcccttttactctttcagccagtaatgtgtcagactgtggccgagttttagagtcttactaacttaccagagatttttcaaaatgctgtaaaataaatccaacctcagtcagccagttaagtacttcaatatttgcaatggcacataaaattctttttagagcactgggatataatggaagtagctctacaaagaaagtttggagacctcagcaagagtctaactctgcttttaggacctgaatgaccatggataagtttcttgcctttctgggcctcagtttccccatcttaaaaagaacagaataagtacttggttgtttaaggatctgtgagaaaaagatagctggtgtcctaaacaagccgattaattactccaataaagtctccttgtttcttctgcttccaggcactctctcagtttacaagtagtcagccatcactttcgtagcagttaaagtggaatcactggcttgatttttctacttttatttaaactccatccattcatcatacctagataaatataaaccaagcaaatactaatttctagggattcaaaataagaataaaatataacctctactcttgaggagcttccaacctagagagaagatgcatccataaacaaagttctccaagttatatcaaaatttcaagagaagacaagtgcagtggctaaattttccagtggagggagggcatcaagaaaggttccacaaaggaagagctattctagtcgatcctttagcaatgaggaggaaccaactaggtgggtaggggggaagcacacgtgtgcaaaggaactggagtgagcaagcaggttgtatatttgaatagtgagtagtccagtgttcataggccatgaggtacgtagaagggaagaaaagtgaaataaagttagaaaaatgctctattatgtcactttatgtctcagctaatggcaaaggctattagttgtttgtaaatatccaggatccttttctttaatgaagtaactcctgtgttttagctgagtgtgtggccgcttagctgaagtatttctcgttggccttcctggcagcttgatgtggcctcgtgactaaggttcaaccaaaaagattgtaagtgataagtgccactttcagaatgtgccccctaaagagcctgatatgagttcctccagccctgtcccttcccactaggtgggagatggaaccaacagaagcagccgcttaaaacctggagatagcagagttgccctacgagccctggacgactcgcctctgagtgttatgtgagagataaacatctgtcctatttaagcaactgtattttaggtattttttttttacagcactgatatgattacattctggaatttagaatttatttgctaagcgatggaaaaccacagcaagcagagagggaaatgacctaatcagacatgcattatggaaagcaagaattgatgggaaacgatgaaatggaaagacaggagtggaaggacctatgctacgaggggctgcctgccctatgccacatactatactaagcattattttgctaagcattgtctcatttaatcctcataacttgtaaagatgatattattaccattttacagatgaggaatcccatgctcagacagatttgatagaaatgctcagggtctcacagctggttgagtggcaaagttggaattcaaatctaagtttgtctgtctctaaagctagtgttctctcctctgcacccaacttccccctagatgagagatgacatgggatggaggtggagtcagtggtaaatagcagcaaacgatataaaatacatttcagaggtggaactgataggaaccgttgactgacagccctggaaaatgaggagttacctacctattcacttattcattttccaggcatgaatccgagattttgtggggggtgatgttctgtcactgacctatttggtttttttccaagtcggattcaatattgtatttgtcttgttcttttcaaagctcagtttgttttctcactttgaatgccaaatgtggttcaaagacccttgcagtggaagtctccaaagacttcctacctccctctgttttcattagggtatctctctttcctttgccacatcaaacacctaccctttggagtttgaaacaaaatctattgacaatattcttgtaaagctggaaaactggttatattgctccctgctatcattagcgtgaaatcgtcttttgcttggaccagaggtctggtatagaatggtattaaaaaatctctattgctcttcagagcttgcatggaagatggtttaattgtgctgtaacatggagatataaaattctggtcatttttcagtgaagagctcaatgaaacatccagaggaagagtttgaaaatcaaattaaccttccatgacaggtgtatttgtgtttcgaaactcaacctccatacgtgataatatcttatttttatctagcagttcacagatttaaaaataattccatatttattatgacattttaccctcttaataactctaagaagcaggcaaaataagaatattatctccagatacagaagaagaaataggttcaagcagttaggcgacttggccatggactctgtggtataaagccaatacaggcagggcagaaatataattcagaagcaaaatgcttcttcctattacaaactctgtgtagataatttcatgaacttctagaaaattaactcaactcctttagcacagtcaagtccggggagccaggcttatgattccagttcttatgaatgtcagagatgagatagttgagaagttgtaggacacactcatggtgcagctgattaaaaatacgagctcttgcaatactatgcagccataaaaaagaatgaagtcatgtcctttgtagggacatggatggagctggaaaccatcattctcagcaaactaacacaggaacagaaaaccaaacactgcatgttctcactcataagtgggagttgaacagtgagaacacatggacacagagagggcaacatcatacaccagggcgtgttggggggtgggggggaaggggagggagaacattaggacaaatacctaatgtatgcagggcttaaaacctagatgacgggttgatgggtgcaggaacccaccatggcacatatatacccatgtaacaaacctgtatgttctgcacatgtatcccagaacttaacaaaaaaagagctctgccattattttcccaaaatagcataggtaaacccactctaattttttacatatgagtaaattgaccccaagagtgaactgcagtgaactgaagaagatgcccatcaaatacaccagaagaccctctgcttctgaccccacctgtattgctgggtttcagtgtcattcactccactcctctcctcggtgtctttctccttgaccccctgtgtatttctcaatctccctctctcttataaaattccatataatttttctcataagtggaaattataatttataaaattcattattaattattccaggtaagaatgattaatattgctgttaaaatcaaaactttacaggcattaaaactgtacccaataaaacttattaactaaaaattagtgaaaatataaaatattcttgagaaaatttagttaggaaaaaactgactcaaaaaaactgtactttgcagaaataatggccataagagaaaaactcatgatgaccaaagctataatcattttttaagatatcaatgacaaaaatgaatactgatataaaatttaaacgaaaagaattgatcctggtgaaaataattttagtaaaataaaaatggtaagggaaaaatattaaaaaccattaaatgcactctatagaaaattaatcaggaaattaaactggcctagaggttttcactccagaaaatactttgttgaaccaaataattcaatgttggcataattctgactgaaatatttatattaagaattgttcggacatgcgcggtggctcactcctgtaatctcagcattttgcgaggccaaggagggcagattacctgaggtcaggagttcaagaccagcatggccaacatggcgaaactccgtctctactaaaagtagaaaaattagccaggtgtggtggcgggcacctgtaatcccagctactcaggaggctgaggcaggagaattgcttgaaccggggaggcggaggttgcagtgagccgagatcacgccattgcactccagcctgggtgacaagagcgagactgtgtctcgacactaaaaatcctttaccaaagacttcagatatctgaaagtctaaaaattatttccttagccaggaaaatctcttccttggactggagttttcatctctttcagatgaagatgttgagatagattatttttcccttatttaatcagatgattagccagatgtagtttattgtgtttctataattatatgatgaggtagataagtattaaattctttaacaatttttaaaactaacttccaagtcattgtaaatggaaagagatcatgaaagtcagtcagaaataaacacaggcaacatgtcatttttggtcacataatatgaagacttagacaattactcatataaatgacagagttaaagcaatgaaaacactttgtcactctgataaataacaaaaaaattgatttactgtataaaccaagacaaaaatcttcatttttcatttttgaaattctgcaagatagaatatgagagacacccttgaatctatatgaataattgagtctgaggtttaagtcctcaaaatctgatttttttatgtcttatgttactggccagacagaatatttcaatattgaagtagacacttcattcagagcaatcataagataataaagcacattatggcaatataaaaacaatcaaccaatgtaaaattgagtcaagtaaataatcaataggtttatgaatttattttgtcaaaatttgttttctctaattttgttatgtatatctgatctcacttaaaacttcaaacattgtttaaaatattcctgtttgaaggcattttcactaattacaatttcctgttaaggtgattttatgacctacgggttgaacttaagatgcatcctgacagcccatagcaaaatatgcagggcactcattcaaaagccactgttgtgcagcaaaccatctggctagagaagccaacaagatctactatgaaaggatggtgatcttggttcagatagctactggctagtcctcccattcccaggctagaggaactataggtcctcaaaaagaagttaacatgcagatgtgatcatttttgctcatttatctatgtatatatttgattacataaaacaaagcattccaacaaaaacttggatttcattcagaatcatttgtctcagagatcatcgaggttgtgttccttggcatatataaattattacagtcttcaattaataacaataatgtatattaacatttactgacacactcgctgttctaagcgcatacgtatttaacctgtactaaaaccttatggggtaggtgccattattatctccactttacagatgaggaatctagggttcagagaggtcctataacttgcttaaagtcacctaggaaatgtcagatctaggatttgaatataagtagtgtggttctaaagcctatggagttcagcctccccagaatagtgtgggttttgggaagaaaatgattgcatacagaaatttaaatttattttctacagcaaccaattgagagctttagacatacattttctctttaatgtggaaggcaactcctttgcaactgtaaatctaaaggccataatttctttggcaaaattatactgtgtcctaatatggattttattttctcatcttaaagtttccctttcttttttgactacaatagccatttagaattcagtgtaccttaagaattctaggttaatgtccttatcttgttttttttcaccccgtgtgtgggtcacagctgccttatctctttaacctaaccacggtgctgttattttttccatttgcattttgggaagatcaagtgagaggagtgatggaataacaccaatatactcagttatgttttcttcatccctaacctatctcaacccttctcaattctggtaagactgtgaaagtgaccatgttcagaaaggcaattgcgtagtttaaaccgctgtgtttaaatgaaaaggtgagaaggaagcttaaatttaaaataactttgatttctgttaactttcactggaaaactatgcacttgatccctaaaaataaaatggaatcgacttttgttcgtttatttaatggatatttaagaagagcctgctatcagccaggcactgtgctaggtgcgtgcaagggacacgaagtgaaataaggcatgacagactgtcctcaaggaggtcacaggacagccaggagattcggacaggaagacaaacatgagaattaaaaatgcacaggtgccgtgatagtaggttcagtgaggatgtgaaagagaaagaataaattctccttggtggtggtcaggaaaagtttcctcaaaggtacaatgctttggttaactctcaaaagaaaagtttcaaggcagccagcccaagaacggggtagaggtaagggcattccaggaagaaggtacagagggacaaatatctagacccaaaaccacaggtcccgttcagggttctacaaggcattcagatcatgttcagtgttgtgaggaagagggaagagctggacaggtaaccaagccctggaggccacacttaaacaagtttgtactttctgacgggagtgggaagcaatttgggattttaagcaagagagtggagagtgctaatatcagatttgtgtttatgaattatcactctggttgtaacttgaacagtagaggaaaagacagccaggtggctgattaggagactgtttcgttagagtgaaagacgttgagcgtatactaagtcaattgagagagctacagttggcctacctggcacctttatgggatttagaaaaaggcacctccctcctcaccttggactgagaagtcccattggcttgaagatgacccttacctgcctcagccaggctcctttgtgtgagtacaaactgcttagcacatgcagcatgtcatgaccttggcagatggtgtgggggtgaagaggaataaggttcacctgacagaactgaatagaatgtgggagatgcagaaacgatgagtctagaatgactcccagatttctaatttgggtgaatgacagtactatttacaaagaaagaaaatttgattacaaaaattgatttgaaagaacagagaactatgtcaaaatgaatgctttcaatgtacatgtgctggaaaaatcaaaacatatttgtctatccagagaggtcgcttgatgatcagcagtgcctaattttactaggatgtagctttctctgtgccctgtacagttgccctgtggctccagagagtctatctgaggcctgcaccccatcccctactccttcaaacctagagttgcttctcttttcccagtctcagtgatgggaatgtgggggacaagtcctctcagagagccaagtgcacattctgctttcctgagagctgacctggaatactatgagtagagtttggggcttacaagctctggggcaagatagcatttttgttttgttttgttttttgttcccctgcctcagcctcctgagtagttgggattacaggcatgtgccaccatgcccaactaattttttttgtatttttagtagagacggggcttcaccacgttggccaggctggtcttgaactcctgacctcaagtgatccgcctgcctcggcctcccaaaatgctgggattactggcatgagccaccacgcctggccacaagatggcattctgaggctttcccttgcatccaactgggaaagaggagaggacctattcctcttctgacagagcataaccatatcagaaattaccaaggaaatgatcaaccatatgagggctggggacatggacgatttctttcaggacctccaggactagacacagtgccacgtagaagaggaatcatttattattggttgatagaagactcctgtcaatgtgatatcttccttcagatagtatatcagaaagcctaggctaggccatgctgtggtcacaaataaccccaaaaccttaataaattagagcaacacaggcttgtttctcatgcatggaacatgtcccttgcaagttggttgaggctctcccttacctcatcattgtcctcactcctggattcaggctaatggaacagccaccatctggaacagccgccatctagatctgcattgtccaatatggtggtccctagccacatgtagccatttacattttaattaaaattcaataaaattaaaaatttaatttttcagttatcctagccatattgcaagcgctcaatgccacatgtagccaatgggtactctactggaaaatatagatggggaatatttccaccattacagaaagttctactcaacatgctgagttagagcattgatgcttttgggttcttgtaccagcaattaaatgtcatgtggtcccatccaaccactagggtctaaaaaatacaattctttcctgtgctctgaaaacagagagctagagatatctggtaagcaacattaacaactacctgttgaggtagagagaaagagaccccagagtatggtgctttggcatgttgagtgttttgaatttaaagacctcagaaataagccttagaaccaaggtctctttctgatctttccctgcctccctgtctctccgatcccctttctttctgcaagcaaccagaaggagctttttctgaagtttccttatctgattaagcaaagttttcccaggagaaatgcaattgtcttaaaactccctccctaacaatctcattaaataaccaggaaagattgaccaccagacaaaggaagaaacttacagtcttcatcacactcagatagacttttcatctcttcttttgtgggcagttctgagagactacctgggagattttatctgcataataaaacaatctttgttcacagtcaagttccagccctgaccttcccaccatcttccccagagctcagagctttgtcccagatgattattctttaggctcactcatttctcctgaaaaccatttactaccccccctaggaagagggtatataagcttcaaccaccaggcctttgagtctcatattttatacagctcccgtgcttatgaacaataaattttctatgcattttcttcccattgatctgtctactttcagttcatttcaatgaacatttagcgggcagaggggaaacttgaccttcatccctacatacccattcatgacttcaagagttcacccttccccttacctttattataatccagggtgtgaacagggagaaaataactcataatttggacatgtgaaaaacagaaaaaaaaatttagtgttttgctccaagatatcacaaaaagttgtgaactcagaatgttcactgggctcaacatctgcattatgcatcctatcttatcttcaaaatgaccctgtgtaggtatgctgtactttccaccttaaatatggggaaactgaggctcagagtggttaagtgacttgaccaacagaggtctacctgatctcaaagcactggagatgctctatatggagaaggaaaatactatttcccaggttttttaagttttactcttcagttccatgttatcactcaaattctaacttctaattttacagaaaggccttaaagaagctgggtaggtatatttggcttagttacaaaactattcatttaaaagcctttgtaggcatgaacaacgatgaacacagacaagaaatgagtctatttcatatgctgaactgtttagaaaacatatgtatgtacacatttatgtttatgaaactgatctgggtgattaagctccttggaaaccctgaaaatctacggaagaaaatttgtgcaaagtgttcaactatgatgaagagactattaagtatgtggcattcgtcttgctcttttgttttcttgaagtagtccttctaccaactttccatcttcttagatgcaaaacgaaacaaaacttagactgtcagtgcacagttcttgctcatttgttagcactggagcagaaacattgttttccgtatagagttggggaaactgtggccctggcagcaagtcctccagccctctgagtgctggccataagcctttgacctgcaacccttgtttcatgagtcctgcttgagatgggagtgtgggggcctgctcctggtgggctgttgattgcatcccggaagccacatggcctaggccgttttcccctttgattggccaaataaatcacatcatctcacctcagtactcttcctctctttccctttgcagcattccttggcagggtaaacagcaccatttcagcaattttaaaggtgacttccaataaaatatgtatgtagatttacttcggggctggtagcctgggctgtaaatttataccaagtcaaccatggaaagcccttcaattaaaaaagaagaaagaaaatacaaaaaaataaagtttccatcagcatttatctttggattttaaaaagtgaatgtatttcttttctcctcttttttaatggaaaagaaaaaaagaaaacatccatgaagagcaactgactgaagcacttcaacagcctggttcataaacctctctggtaatgcctggaaataaagagaaatcttcagtgtcaccaaagattgcttctcaccaaccctgtgctttcagctgcagacgtgcatgcctgacagcctgtacctctggagtgcaactggagccattgccattggttcccccttgcttatgaaaacagagggattaacagacactgaaagagaaaccccactgagccaccagcatcagtgggcttaaacgctttttcctactgccagccagaatcctttcaaacctcagcacccatctcttttgaggaaaactgtcttaacatccctgtaaatggataacctttggcttctgccaaacaaaggctgcagattgtttctatttatttgccaagaatttattggagtccataaaacaaatttctgtagctggggaaactgtacactttttgtttgttgttattgtttttaatctaggctgcaatccaaaagtttgcagcatgagtgaactgttgtggtttgctttctagttttatttggcctagaaaaagaaaacaaatggcagtgcttcgtgtaacatcatatattagaggtttctagtgcttggtatttgccttatcattttcaaaacagaatcttagaaagggggaatgctaaaacatgaagtccatggtatataaagcagttctttaccaagtagtaaaagcattaataaaatcaaatttaccttcataacaacagtgtacctaggtgagtagaaaatacatttatctcattttatggataggtatactgactcagtctaggacccatcccattctaaggtcattcactgtagaaacacagaatcagctggagatagaccagtgcctctgtcactgtcccagagttcttaccctctgtgcttgctccctgccttgcagaatataagagattcatttaattttgaagcataacacttcatgtgaagggccctataaaaaaatgtgtgacaaggccctactaattttgtaatactaaaatgtatctctgatgccactgagtgttgcatatttattagagcttttgttctggtccaaaatggaaaatgggaaacaggataagaaaaatggcactaagaactccatgataggccatgcatacttctgtggaatggcatgttcctttgaagatttgattcatctggaagctatgacatgcataaagcccaatttcaactggataaagaaatagacaatggcattcatccgagttttgtggtgactggaaagaagtttggtaaagtaacatagcaaccatgtcccttctttcttttcatgcccagactcttcaagtgaactgaccctataattcttgggaaataatacactttgcagaacattgtaagaaggcaccattggaggcagaccagatgctgtggactgggtcccactcagttctgtcctcacacctggtgcagtgctgggcacattctgtgtgatcatgggcatgtggtgcctgtgtttggcttgttgggtgtagagatcagttgaccatgtcagaaaaactaacagaaccatggaggatcatgagcaaagccttttcttttccttgaatatagcttcaggctttttttaaaaattgttttaattattcttctcatggcatcccttaaactacctaatcatggaattagcctgacagtcggattgtagctctaagtttgtattttctggtatttgcacaaatatgttaagcatctaaaaatataacatttcaacatgccttttataagtaagcaaatgcccagcacctttctgacatcccgactgagtcatctattactcactatgatgggaaggaaatcagcggcaggctatgtgatgagaaacactgttgatgtggtaccatatcactgtcaggtgtgctcccgtgttcacctaaaaccctgcaggttcctgggatgcagaaagctgggaagaatagtaagttgatgagtggacaggaatctgcaagacttgtacatgtttcaaagaagcaccaactctgtatatgccaagtatactgtaagtaccataatgggaggaaattcaacaatttcaagctaacattaaagaccgcttctttttctgaatacttagctgaagaaactcagggcttctgaaggacagacaagttcttcatagccactaacagtttttaatctttgcaattctgatataactcaaatatctccaactctttatctcacagtattcatttgcatctccagtgcctacagtaaagccaacttggagtgaaaccattgtgttccccaatgaggctgctaatcctttcattttctaataatataacaactatatatgcttctttttttaaaggcagctgaagcagaatgggtgtgcatgtgtgtgtggtttttttgttgttgttgtttttgttctttgttttttttttgagacagagtttcagtcttgtcacccaggttggagtacaatggtatgatctcgtcccactgcaatctccgcctcctggcttcaagtgtttctcctgcctcagcctccctagtagcttggattacaggtgcccatcatcatgcctggctaatttttgtattgttagtagagacggggtttcaccaggttggccaggctgatctcaaacttctgaccttaggtgatctgcctgcctcggcctcccaaagtgctgggattacaggcgtgagccactgtgctcagccctgcatgtatgttttaataaggcatctgtctccaagccacaaggcccctggcaaaacctctaaccctttcccttcaacacagcggcatccctttttatcacagaagtgaaggtgtaaatagttccagagattcacaaggcaattccaaagcagctctgttttcagtcaggcttcccagaacctactttgcttcaggcttgaacctagcaagctgacatcatgtttcctaagcaggcaaggtgccaccagaacacacaggcaggggcacagctgaccagaaacgaatggggccatgtgaggtgcaagtccaagacagcaatgtcaacacatctgactgccaggaatagttacactctgggttaaagggctcttccaatttcaactaagataattatataaacaaatagcatctgtaggcataaaagatacatgatctgaaaagaaatgctatttgtttctgatgaattttcccagaagctgaacatagctttatttcatggagtaatatactaggtttacagtatcactagagttctttttatctcaagatcgtaaggacctttgcaatttcattaatccttacaagtgaatgctcaaaaatattggcctctatacaaatgttccccttaataatacaaattacaataatcttttgtaaagaaataatttacagccgggcatggtggctcacacctgtaatcccagcactttgggaggccgaggcgggtggatcacgaggtcaggagatcgagcccatcctggctcacacagtgaaaccccgtctctactaaaaatacaaaaaaattagccgggcatgatggtgggcccagtagtcctagctactaggcaggcagaggcaggagaatggcataaacccgggaggcggagcttgcagtgagcagagattgtgccactgcactccagcctgggagacagagtaagactctgtctcaaaaaaataaaaagaaaataatttacatggaggaaacatatgtgcatagataggtgtgcatacacaaatatatatattcaaaaatgtttgttgtagtgtcatctgcaggattggcaacagactgaataccttccattagaaaaacattgattgaaccatagttaattctcttaaatgaatgatcctcaggcaacagaaatagacttacaagcttaatagacttgaaaatgctcatcaagtaggcataagtgttttaaaaagtaaactgcaaaattgtatttatactatagatataattgtggaaaaaataaatgtatatagacaagacctgaaaggaaatatttttaaagtggggagaaaatttttcataggaatgggaaacttgagaagtatatacctcttctgtgtgtttaaagttgttataatgttgtttgaataacaagaaaagtaataaacagttttacttgggaggctgagggaggcggatcacctgaggttaggagttcgagaccagcttggtcaacatggtgaaaccacgtctctactaaaaacacaaaaattagccgggcatggtggcgcatgcctgtaatcccagctaccaaggaggctgaggcaagagaattgcttgaacctgggaggcagaggttgcagtgagctgagatcgtgccactgcactccaacctgggtgacagagtgagactccatctctaaataaataaataaacaaagagttttccactttacatggaaactgcttcttacattacctttagtaggaaaagtaaatgttcaggtgcaggctgtagggtacttgtataaaatttggaagattttgggtaaaagaatcctgcagagagaatgtagtgtaccccataaaaccctaggatcacatttaagctctgccttaatttaaaaagaatctctattttgcccataccccacgttttctttctctcacaaaagtagacaacttgggaatgctaagtccatgataaaaggtgttccctactcccactgccttccacctgagtctaagcctcttgattataggagggacaagattctcctacaaggcagaaatctgatgtttccaagttaatgtataactagtcaatcaaagaacaaattgttactatttcatatggcaaaggtatcttgtgaaatatgtatagtgcaaaattaaaaaaatatataatggttactctttattggcccaggaattgtgctaagcattagcacaattagatatgcattatcacatttgatcctcacagcaaccctctaaaatatgttccattaatagttccatattccagatcaagaacatgagatttgaaaataaattcactgttaaatggaatcaaagtaacctgtgacgccaagaccatactttaatagacctgtactctccagctttccaagtactcatccaggtacttctaacatttttacattaaagtctatcaggcttcctctggacaactcagtgattgcctttaacgggcaaaggtataatattctcccagcatggaggtgatctgtgtccaggacagacaaatcctagaggtggagaaatgcagggtaattagggagaaaccatgcagagaacaagaagctagaagatggaataataactgggcctagaggtgtgtgttttacccaaaattcatggattatcgactcacccacttaacgagtgacacctaaggccgtggagattgggggtggaaggcagataggcatctacttggctggagattgaaagggcagctacaaataatagctaaatttgggctaaggaagcaatcttgagctaagctaataagaaccaccatgacccagagatccagggccccaaggaagaactagaagagccttccaacgaaaaggttgtgagtcacagcacctgagggacttgtttgggatttttggctttggcaatctccctggatagcctgagcctaaacttgtagcttcccttgtgtgcaaggtttataccctctaaaaccctcacactgagatgaaagtttgcaatgcacttgaaccagcattatatattgaattttggaataaaaggagccactacaggaaaggaagaggcagttagagaaaacaagaacatgagaacagtggtcttttgaggaaaagcaacaaacaacagacttaagacaactcaatcacctttgccttgggtctgtggaaccaggggtctgtgcagcgcagtgtgctgataaaaccttggcccttggagctagagaaaccaggtccacctcctaaatctcccacttcctaaccctatggcctcactttgaatctctgaatctgcatttcctcatctgtaaaataataccaatcacacctgcctcctaggggttttgggaggcataaatggcataaagcttgtgaaacagcccacacataataagtgttcagctacttaagtcctgtttctctcttttggtctgagagtcacccttattaaccaggaagcttatggggaccagttcgaatagcattacatttcaaatacgtacctcaagagcccaaagtaacagcattgttctgtcctctttctcaaagaatattaaaatgattaaaatactaaatcttttttctcttctctttatttccctcctacctaatgttgcactaaatttttctagcgagtttgcttcacgttagtagtttgcaatcagccgtagttggaattcttacaccatggaactgggcaaaggctacaaatgggctcttttttgtttccagaaagctggtttgtctgcacaccactgttccaacccacagcttctccaaagcctttctccttaactcccaacttatccccacccacctgcctctagagtaaactcatccttcacactcaagcttcacggcttccctcccttctgtattaccctccctatgtctcagcaagttaatacgtagatcaactgtgcttctccctacatgtagaggacagagaagaacccagctagcaaatacagggctgtctggtggaataggaaaaagatgctgttaaaccaatactgggtcaacagcagctttcccctcaggaggatttgacatgaacagcgatggtagttgctctatactaaacttgtggcaccttctaaaactaagactgaaggcttccccactctagagtgcagcttatatagatagatagatagatagatagatagatagatagatagatagatagatatatctagatatatatatatatctagatatatctatctatctagatagatagatagatagatagatagatatatctagatatatatatatctagatatatctatctatctatatagatagatagatagatagatagatagatagatagatagatagatagatttttttttaccttaaccaaagaacaaaagaaaaggaagcaagttatttactttgggaatgagggcttgtggagtctatcttccttcacctcaggggctatatcacttacagccactgtctcagatggtacctggagtccttcctgcccatgtttcttgaaggatctaatcagacatgatgtcaccagtttctatactagtggctctctatcagtggtccaacaagggtcgtctggggcatgaatgacccattatattatataatgtgatagtaaactcaagaggttaaaaaatttatccaccaaacaaagcttagcaaacataacagtttgcctggtgtagatagtagtttgctttttcacattcaggccagactaacaagaccattcagttgtgagaagtatccttctcatgtgaggattctacaggctgttgtgtggtttgttgtcccctgatgcagtccctgaagaagctggtctcctagattgcattcctgtcctcccttttgtacatgcattgggattggcaagtgtcctagacaaaacagtattatattgccagtcagctgccatttgactgaggcttttaagttctgggatacaagtgcagaatgtgcaggttttttacatagctatacatgtgccatggtggtttgctgcagctatcaacccatcatctaggttttaaaccccacgtgcattaggtatttgttctaatgctctccctccctttgcccccaccccgacgggccccggtgtgtgttgttccactccctgtgtccatgtgttctcattgttcaactcccacttatgcatgagaacatgcactgtttggttttctgttcctgtgttagtttgctgagaatgatggttttcagcttcatccatgtccccgcaaagactgtggcatttttgtaattattagtgaaattatagaccatggacttctccacgccactatggtagcagagaatcttctaagttatccgtaaaagatttatttaaatattttattttctctcaaactgcatggtgaggcaaatatattttatccacaggaatggccccaggcagagaaaagacaggaaaacaacatttacttggcactggctgtctgccagacactattctcagcaaattacctcatttaatcctcaccctatgagggaagtactattataattcccattttacagatacacaaatgaagaatcaaagatgtaaaataattgcccaagagctagaaattggttagaaactggttgagccaggatttgcacctaagtctatctggcatattcttcccagtaagttgtgctatgttgcttatctgggagttcatcgcctagtgagatggcctagccaggttgagcctatgatgaagaaaaatattcatctgaagaacaacttgataggctgaatcaaattatttttaaaatctactggagggtttctgaggctgccaggacttggaggccaagatcccgaagagaagagaaatttattgaggcaatgtcaatattgtgtgctttgcaatgcttgtaaaagtgtttgctgactcttacgtggttttggacggaaggcagctgctgaaaggtagataaaacccatagagctttccataacctcatttggctggaggaaagggttgggcttactaaagcagtcagaactttgggaaccaagatcctaagaaataaattaatgcagaaaagtgaacccatcattttaaccaagttttcatctcaggacatttgctaattcttaagttttgaagagcaagaggctaagaagccaaagtaactgaggagtggagtttttagcagtcttgtagagctgtgagatcaaagttggagttcaaggctcaccaaagaggagaagacctctaagcactcagggacttacactagagacctacactcaagaaatgtaggtgaacagaagaagaaacaacttacaaagcttggaacgagctgtgagggttagggtcgaattgtggaggtttgctcctgtctgacagaatatatttgggaaaatagttaacatcatccagagcatcttcaatacttcatgcacagtgtctgacattcatctaaagttaccatgcatgccaagaactaggaccaagagaagaagaaaaacagaaaatggaagctgacgtacaagtgatgcagatattggatttttcagacatactttaaaataactatgattattaggttcaagaaaatgcaaaacaagatatagaatttcaccaaagacctggaatctgtaagaaagaattacacaaacattctagaaatggaaaaaaatacaagaattgaaagtaaaagatgtatgagaacccaaaggtatacctgtttatttaaacccagaatttaggaaaagccaacaatacatgtagacacatagctattaacaggcattttctatgtgtaaaacaaggtcaataaaacaatataaaaaataacaaaacacaaaatgacctttatagcatggccataaaatctgaaatattaaagatatcaaagcagcacctgattatgttttaaagattttttatgtgtaaaaatttactaaaaatacaacataaaatcataaaaacatacagttggtggagaatagacaaagcccactctttaagaaaaattgtctctataaaatacacaaaagatgaggtaaaaaaagtgaatcttcctttatttagacattatcctaaaaataatagatgataaactcaaaagagtacattctatcaattatacatgctgaaaatacggtaatgataatgcataatatattctgtatctgtaactcatcaagttacttgaagttaaacaaaaacacacacacacacacacacaacttgattacattattctcttaagaagacattgagaccccaggaggtccaggctgcagtgacctgtgatcaagccactgcactccactctgggtaacagaaagagaccctgtctaaaaaaagaaaaaagaaaaagaaaaacaaaaacaaaacactgaattttctttttctggctaagtcttctccatttgcttatttcagaaatttgcttttccaaagatgagttcaccctgtcccattttggtacaaaacctttcattttatctttgagcttctgaattaacactttattcctaccaaatcttattgttcagggatcaggcagttagtttaaaggatgaatcatgcctatcaacaggcctggcagttgcagtcaacagcaaattgtgatttccagaatgaaagtgacttgttgcaggacaacacttaccagcatgtgacctggggcaagtcacagcctccctgagcctctgcatctgtaaagtgggctcaattccacctccttcacaaggctgttgtagagattaaacaaaatagaccatgtgaaagccctgggcctcatttatgtttataaacaaatcctgtatttttaaaaacaaatttccacatttccttcactcaacacacatttattaaatatctgctgtgttccagaatccttgacaggcactgagaatacaaagaccaataaggcatgcactctgcagtcaaggacctcacagcccaggagggaggacagacaagtaaataaagtattgcaagacactattataagtggcggaacaaagcaggaacttatcaactctgttctaaaagtcagggaaggctgggattatgaggggtaagaaggaaataaggcagatgaaggaaattggaaagacagtggcagccaaagagaatgtacaaagccccagaagcatgaaagagcattacacatttatgaaactgtaaagtttcaatttcccctttactaaaatatgagatgcacattgggaatacataaaatgaagcagagacataatcttgatcactgaccttcaggggctcaatctgatgaaagaaaaacacacatatgattaatctcaatggttatgcggaaaattaagaaaaaattccacactgtatgacctcatctacagaattttttttaaaactatgtaaaaaagtgactagaaacaaaagagaaacaatccaatttttaaatgggcaaagatgtttatagcagcacaattcacaatagcaaaactatggaaccagcccaaatgcccatcaaccaacgagtatatgtggataaagaaaatgtggtatatatatatacaccatggaatactactcagccataaaaaggaactaaataatggcatttgcagcaacctggatggaattggagacccttattctaaatgaagtaactcaggaatggaaaaccaaacatcatacgttctcactcgtaagtggagctaagctatgaggacacaaacattctcgctcataagtggagctaagctatgaggacacaaaggtataagaatgatacattggactttggggactacaggaaaagggagggaggtgagggataaaagactacaaattaggtacggtgtacactgcttgggcgatgggtgcaccaaaatctcagaaatcgccactaaagaacttattcatgtaaccaaacaccacctgttccccaaaagcctattgaaataaaagaaattggataaaatcttaaaaaataatagtgttaaaattagatgtggtattcaaacctcctgatttgggtagtggtgcattttcacccaaagttgaattacaaggaaagtaccaaaaaaaaagttaaaacgtgggcaaagaatttgaaaagatatctatccaaagaaaacatacaaaggagaaataagtacatgaaaaggtgctgaacatcattagtaattagggaaatgcaaataaaaaccacagtaagatactacttaacacatgctaggatggctattactaaaacttaaaaaaaaaaacccagaaaataacaagtgttggcaacaatatggagatatcaaaaccctcatgcattgcagctgggaatgtaaaatggtgtgactactgtggaaaacagtttgatggtttctcaaaaatttaaacatagaattactatatggacccataattccatttctaagtatatactcaaaagaatttaaaacaggaactctaacagacacttgaagaccaatgttcatagtggcatgagtcacaatagccaaaaggtagaaacaagtgttgaccagccaatgaacaaagtaaatacatacaataaaatattattcaaggataaaaaggaattaagttatgacacacgctaccctgtcaataaactttgaaaatattatgctaagtgaaataaggcagaaacaaaaggccaacattgtatggttccactaataggagctattttgtgtaggcaaatcgacagagacagaaattagaatagaggttaccaggggctggagggaatggggaatagggagttatcgcttaatagttacagaatttctggttgagataatgaaacactctagatagttgtgatggttatacaagattatgaatgtatttcgtgccactgaattttacacttaaacatggttaaaatagtaaattttatattttaccacaaaaaaatttttttaataagcagtggaaaaaaatggaacatctctaaatattaacaatggtttctctgtgtgatatgcaccccccacctcatctcttactttctccacttatttgtattcttttttccttaatgaatatgtattctatgtttttaaaaactctaaattttacttttcaaaaagaaagaaaacaaaaaaaaatatggtaagattttttaaatctatgttttagctatgtatgaagtcccttgggaatggagaggccatcatctagattgtactagggctggcaacaaccttgcaaccagctcgtttgaggactagaaaaatgtggctatgtgtcgtcttgccctagaaaacctcttggaggagatgtagcctgaatccggattattgtgagccttctgcaaagctttagctctgcgctgcagccccatgtaggccaagacgtctacaggcgccaacttcaaagagacacttctcccttggaatgcagctgcccagctggcctgaaggactctgcagagattagaagagtcagataacaactttccactgaataggaggtgggatgcaaacatcagctagtttcttcctgggactccctctccctcagggcgaggcctttggctgtgtaggaccaaacatcaggcaccaaggcttttcccattttggggaaaggagggaagctaattttgttgtattagcaactggcttctggaccttgctctccttccctttgtcagagagaaagcacaaatgatattgtagccatgtatctcaaacttggaacaaatagttttagaactgggccctgccatggaattggatcatcaagcaaagacctagagcactgctagtttgctcagggttttgtcttgagctggtctgactgaagggcaactgaactgccaggggaggacggactatgatgagctcccaggaaatctgtccctgatgttgatgatactcaggatatttcaaaagaagataggtttaaaccacaaggtggggagatgtggacccctagcttgaaagctccttaactgttaaggggcacatgtgggagacttctaaataaggtgctgaagatgaaagttgccttttcttctagggttgtatcagaaggttgactctagatttagttcagttatagccccagggaataagcaccaacagtgaaaaccttctcctaggtctgagaaaacttatggccacacccttgaaaactcagaccacaccctgaaattccacaccttggaatttcattcttttgcttttaaactctgcagtctcataatttcagaattgaactaagggttgggacacagatttttaacacaaaatcttcattttccctgtgtttttctcctttgagatatcacactttctactgcaggtatctatatacatataataaaccttgaatttattctgtaaggaagctcatcccacaagggacaacagaaaagccagagggtgacatgtattaaagatgtaatatgtaaaaatgtggcagacctgaaaagcacacgtctccaaattgaaaggtaccaccaatgcccggcacaataaatggaggtgggagagagagaaagggccccacccacagggcacaccatctcagtgaaattgcagaacattgggagtaaagaaaaagtcctaacagctttcagagaagaaaagtaaatcacatacaaaattcaaaaattaaaatgacatcagactcttcaatagcaacactggaagcatgaaaagaatggagtagttccctgggaattcagagggaagtaattttaatatgaaattttctaccagacgtatcaaaactcaagtgcacaagcaagaagaaatatatttttccatatatatggctcaagaaatatatatcctatacactcttaattaggaagtacattgagaattcatttttagcaaaacaagaaaataaaccaaaaaaagagtttccactaaagaaaggttagaacaatcagatatctgatgtgatgaaatatttggaaaatattagtgataggcattagagggttttttgaaatatttggagtggggaaaatacatacatggacctacgcataacagtaaaaaaagcaataattaactcaaaaaaacctgtaatcttagaacactagtcaacttagtagtaatatttagcgacaaaaacaaagactgactatagatttaaccaaagattgtgacatatgaagggatgggatatggggaagtttggaggatttgtttttcaaggattttagggggtaaattagagagcttagtaacagaaaataaagagattatgtttaaaatgtgttacataagcaatagtaatattaagatgctagttagaaatgcagagagagtgtatattttaaaagaaaaagtcattaagagttgcaatggattgcctctgggaggtagaaatgaagaatggaagagggttagtttacttttagtaatgtttcataccgtaaaaataagaaaaaaagaaataaactatgtaagtgtattactttggttaacaaatatttatttttaaaccagtgtatcagatttcatcaaaatctgtaagaattcaagtttttccagccagaataaacaaataggaaatgctgaacagttagaggcccacctctcagtttagtcgttggtttcacaaaggcaaagaaaccaaatttatcttccttttgttatgacttccacactgattttgacaaatttcccttagtgcctgtgctccactgcaaattacttatttttctgagtcactcttgtctagaccacaaaagcagcccctgcactgtgtgtggctgatgggaattgcaggttgttctcagatttgtttgtacagcacttcttcccttgcccaaagtatacattatatgtgaatgaggctcgtcacagctctgcataattaccgcatttggagccattcttctcttcagaagttttcccccccttttccttttgatttcttatattttgcagcaactgtcatcattattttgatgccatggcttaatagcgccttcaaatgcaaatttgacaacacaagctgaaaatcatgggtggcaaacaaagcaactaaacttccatgcctgtgttttttgagagctccacctgatctgtaaatgcacacgttttagtagccagccctgcttacaaccttcgtctttgtattataagaagaaccagaattttctgaagatattctgcaaatctaggctgtaaaatggagtttcaattcctcttactctgctttttacaattctaactttgcagatagttgaaatccatctggaggctgtttcccaatgaacctgttctctttgtatcatttatctatgagtgataagtcaaatatttcacaaccacaactgcccaggcattagccaagcaagcagaggagcagtcgggcaggagctcctagccagcacaagccttctacttttagttgctggaccatgggagaggtggtagggatggggggtctctagtcagggactcgaggggcaacgatggtgcttgggaggccagaagagtagctgtacctaattgacatggaagtattttagtgttttgaccacccatagagcagtatctatgcatagtgaaataccattcctgtgggattcccatcctgcctgtaatataattataatatagcttcttcttccttctggtttgtaagtttcttgaggggatattgagactcaggttcttctgtgtgacaccatgtttcctctggatgagtatatgaatgagaaaatgaatgatgaatgacaaattatttctcctcctttgtgagtctagcttccttactctcatttgaaaacatttaaatgtttcagcttactctcatttcaacatttcagcttactctcatttgaaagcttttcatttgaaaacataccgaaacttaggtaaagaaggacatttcataatcacaaatgcagttctttgtgaggacaagagatttagaaataaacattcaggaatcaaactatgctcttttcttgataaaagttatcattgtcttaatagatatttgggagaaagaggaaagtatacgccttgtactttgttagttttgtaggcaggtgtggaatgcaatggaaaagatctcatgctaaccatttttcttttgaaaaaaaatggagattttattggcagtgttttaattttgcaatattttattattttattttattattttggagacagagtcctgctctgctgcccaggctggagtgcagtggcacaatctcagctcactgcagcctttgccttttgggttcaagtgattctcctgcctagcccccagagtagctgggacaacaggcatgtgccaccatgcccggctaatttttgtagttttagtagagacggggtttcaccatgttggccaggctggtcttgaactcctggcctgaagtgatccacctgcctcggcctcccaaagtgctgggattacaggcatgagccaccgcacccagcctaattttgcaatattttacatttaaattaatacaagagaatcaaaccataagcaccacactggtaactctgttttctctgctgaagctaattgaagaacagagagggagagaaatccataaattgtaaggaagaaattagacttttttaaaaaatcaatttcaggacctaaaagttatcaagctataaggataaggaattgtaaaggaatgtgatttttatctaggtcataaaatttaccgctgttttcctttcttaatttaaatgtagaagtgataggcatctacaatgtgccaacccagcaggatctgaaacatgaattcatcataggttaaaacatttatttttcatccagagggaaattggcatgaaataaatttatcaagggactacacgtttaaagcatgcattgcatgactgcctaggacaaaaagagaattctagtatattaaagtaataattcctcttgaactatagctattaatgtaagatgatagaaatagaccaaaataaacaattttcaaagaagagactgaggccaaagtatcatcttgcctctccaatactttattagttgtagtttgtagttttagctactcatgttctcaaaacaattacctagaattttctcagctcaatctgaaactgaggggagttaacttattgatattacactactgatatgaatcaaatgaaggctgtttctttccaagcaactgactggtttatttaatgtaagaacagttgatcatttgaagtaaatagcaaatcactgtaactagtatccattagatttcaggatatttttcattgttctttaataagattctgaaaataatttgtgtttctctaataacatgcttcaggagctaccatgtgctagactatcaccacactgaaaatgtagacataaaaaacaatctgtcattttggaactcaagacttactgtggggaacagacaattccacagataatttcagcaaaacctgagaaatttcataacaaaagaaaccccggccccagccacacacacacacacacacacacacacacacacacacacacacacacacacctgactcttctctctgctaagggtgggagataggagtaaccaagagaaagtctcttaagcaacccctgagcttgctaagaaagtttgtaaggaaatagagacattagccaggcaggaaggacatgccagaaagagggaatgaaaactcgggaaatgcatgtggaattgcaaaagcataaactcagactggaattccttagagaaaatctagtgtttaaattaatgagacacacagaggcccaaaatctccttctagaaaagtcatacagagtgaaataattaacattttccttttgagagttatcattgcattatattctttgttgctttcaataaaacatatatggaaaaattcccaaggattagctataaaaatgcttgggaaaatgccagcattggccattacaagatatttctataatatttaaaatttctgtccctgagagggtaaataaaatactaaatgcttatgcccatagaattaagactgaaatgtgctatatttgaatatttttagaagagttacatgtagtccatctatgtatcacaatgtgaactcttcaaaattgtctctccataacagttttccctatataaatggaaaattgaaaagctaacatgagtcatgtggaatgtgcattccttagaaagtaaaatagtctcatgttctcaagtaccaagtcctccttctgagtccagctaagatttggactggcctagaagatacagactgtccttgcctcctgcattaatgagatacacctacatgatttccgtgtacctcaattttttgctgtaaaatgagacagtagactggataacctctaaggtctctcagctctgtcactctacaagattttcatttcatgcttgacatcctaatgagtttcccaacaccagtcaatgaaaccacttctttggcaagagtcccagctatggagatcaagggtcttattaattgtagcttgccttgtctcacctgagtcataatcgtatttctccacccctaagtggagcacattagaccaatgctcttcttttaggttttcacctagcaagggctgctcattcaactacatcaccccaagcccaagtcagagtgcacaaagaatatgaaagacttcaaggtggtagacacccaaagcattaaaaaacctttctccagacaacctcctatggccctattatagaggaaaaaaaaaaaaaaaacagctagagggggtgcgatctctgccatttgatagcgttatgttgtctccattgagcctgtcccacttagtctctcctgagtgggtctaaagcagtggtcccagggttttttgatcacataccacctcatcaatatataaatacttatattcatttatatattacatatgcatacgtatttatgaatattcacataatattgaactattaaatcatgtagataataaaacaaacaaatagaatctttaaagtatgagatttttaaaaatagatgttgaagttccaatattctttctgaactcttgtggattatctcgagtgccctactttgagacaattgatttaaagtgctcttctgaatgacctagacatttacataatttatctattcttctttaatcttttgtaattctcaactgcttattaaaaattgtaaaatatttaaatttcttaaaatccccaagttttgttatttttgtgagaggcagtcagttttgcctttttctgtgaatgaaagaggtgaatgaaggccaagtttagcaggcacatatcagatcaaatcattattgttaaaattattgattcatctcagctctccaaaatctcacccttagtcctcatttttctgtaccatttattggatcttaaatgtgtttttcttcttattggaaaatcctttttcacgtgcatgtgaggcataagatagtaatgctggtttggtaacaaacactccaggaagtatagaattgcatttatttttataatcatattttatttcctttttttggtttctttttaattctgtcacccatcttaattactcaattcatttacttgattaagccattaataatttttaaccatttccaaaaatcagacccatagaaaaggtgtgttttatggctaaataacggcaaatatttagcatccttggggctatttaaaacaatgtgtgctagagttccagcagtaaatccaaagaggtttgacagcatctttaacatcggtgtataaacaatttatacattaaaggaaccatatgagtctatggtttgtaacaatctattttatttcttcatagaccccactgtagatgttagcctctccacgtagtttggaaggtaatggggtgtacagacagaggttttggaggactttaaaccagagttcatcattaattatgtgacgctggacaactgaattgcttaacctcctagtctcagtttcttattctgaaaaataggacactacctcttaacatggttgtaaagactgggtgtttataaagcttggttctgtgccagaaaagaacagatattaaatggcaaatatttttgctatgcttttaaatccttaaagattatgatttgtatctttttttcccatttagtacaaagcaagtatcttatctggagttaatgtttagaatttttctattgactaatacaagtaatctgacactttgataattttatttaacttcataggagtaaatgatgttctgagggcctgttatattttagagattaaagataagatagtttgacaatataacagtaacaacaaaaagtctgtttgtgcaggcccgtctgctcttccagcatacggaacattgattcccagggtatgaagttatctgagctatgaggtacaaatgagaaattgaggtgctctaatcctgattctaccagcaactgtgtatgatagatctgcaaatcctttctcagagtcaattccacaatgcaggtctgagtgtgggcggtcaaatctaatcctcttcatttggtgacttgcgtaatcctctgacctccatctttggggataaaccttatttctcaagggaagcagggaatgttggtttttctatccatatatggccagattagattcagtatgagtgtgtatacgtgtacacacaaaaaaggcagagatagtcaacttcatcttctacaactctctgccttaatttatgagaaactgggcctgaattttaatcattcaccccaaaacaagaaagcaggttactgtaaagggccaggccatgagaaggcacagcgtcacaatcagatatgcagagaggctgtctccccaaaacacagccccaacttttctgttggtttcattaccattgactggccaggaaagcccacactgcatgccaccatggggattgatagatgctgtggaaagatcagcttctccagctgatagttccctgtgagcaaaaatgcatataaggttaatcagctctgaagcagttcttgcctacattagaaagacaatgattaaatttgcataatctggcaggtggcatgtcatggtggacacacatttttgacttagaatcaaatgaccttcgttggaattctggtcatttcatttaatatctatgtgagctggaaaacgaagcctaaattagggtatccaacattctcataaatttttttaggggagaactgattgaaagaacagaagttaacaattctctagaccatacctggtatgtaatagccattcaataggtgttgaatctgcattaaataataaaatgaagttcttgtttgggtttatactcctctatctcatccctccaacatggaaatttgacaaaaataattttaaattctgcttgtagaacaatttatcatggatttggatttgtgatcttttggataataattcagtattaattattttactgcatcaaagataggttttaaagatttacctctgtatgaaatttaattatatttgcatagagctatgctctgcaaaaggcactcccattttctcatttgttccaaagttaatacagttatgctcttaaattttagcatcaatttcatggagatgagtttaaatggttttctgtgcctggatacgaacagggctttttattttcaaatgttcatttgaaaatggcaacatatcttataacctactgagaaatgacactcaaatagggcagtgtttcaaaggaaattcagaaaaattacaagcatagattaaagaacgaatgtctgatatttgctttggctcctaagtgagtgtaattcacccaaatgggtggcacatgtgcagtttacagcacacttggaaatactcaaaggcccactcttcacagtggataacttaccaagaaacacaaacaaatggtagtctctaagaaataaaatattggtgctgaattctttatggacagtttattgtagtacaaaggaagtccacattaaagcagaagaaggaaatgattttgttatactaatacattagatgattttcatcacttttgatccaacttgaactagatcttcaaacagagttcatttttgcaggcttattgtgtaagcagtgcagctgagggaaaatgtggaggagatttagagccagaggacctggttttgaatctcactcacttctcccacttatggactctgtgatcagtgattaaatttatggggagactgtttccccatatgtaaaacgacaaagcaccgcaaaaattacctcaacatttattaggaggattaatgagataatacatataaatagccctcaatatactgtaaagtgctaaataaactgtaatttcagtgtagtaatattagtatgagtagtgataagagtaatactgatatcgagatttttatgttgccttgatctaagtatgtatgaccctattatccagtccaaatcccctatccctacatagacaaccacctctgcctccaggaaactcctttctgcacctccttcaggttcaaggcataacaaatgtgactccttattcacatggcataacacccaatatgtgaagacttcagctacatcctcctgtggcttctcatctctgtttaacttcctctaaaatgttcacagattactcaaatgatattgttaatttattcattccatgaacaaacactagattaagggttatgatgtggaaggttctatgaaggcactgccagaccacctctcccagataagctgaggttcaaaactctaaggcataggcaaaaaataaaaatcacatccaacatctgaggatataaaatattgggggacacagggacagagctccacatgctcatgggttgcagattgtgaagccaataggaaaaatggtgttttgaaccaccttatagtcagcaagccaaggatgcttgccagataggagagactatgagtacaaggactcagagacagaaacaaaggagagtgtcaggtctacagtgtagggggagaacagagagatggctgcgattctatagaatttagactgttcttggggaatgagaggagatttttggggaaggggctagtcctgctttagtgggaggagggaggtaaaggtgagtaagcactgaacatgaagaagagtggtagtcagatctagggtggtgaggaaagggctactggttggttggtgaaacatcttatgtgctgggtattgtaaatggcacaaaaaggaatcaaactcagttcctccaagaagtcaagatttaatgaagcaacacctaagaatcaaatgacatgtctgctacaggtgttcacaagaaggttattgttctgatttccagaaaacagtgaaattgtccaagtacaatgctggctgtttcccaagaattctcaatgaggtagaatttgttactttggtgaatttaccatgctccagagtctgtggctcagctttgcaatttctaaaactggattctgtaagcacatcaagagtggctctgaccctgcaggacagatttgcagtagccaagcccatgagagacagagtaccaacagactcatttacaacaggagccattactgtcatacatcctagaatactcacatggcacaatcagaacattctctccctgtagcaagcctatgtgggaagtcaatttgtaaccagagggtagcttggtggacacagaatcatggcatgaggaaagagattatttgaatgtctaatggcatcaagctacaacagaaggttgtattcattaatcataatactaatgtccttgactatttgcaaaattctgtaactttttaatctcttctgccctggactaggctgggaaatggttgatcattttctctgactcattttttcctatgatccacctcaataattgatgttttcttccttagacttgtttaatgcataatgaacctggcctaaactctctctcttctcatccaacatatgttgactttgatgttttgactctgggaagtccatttcatttccacagtttctctatctaggggcagaggtaggtggacaggacagcgagcaccactcatcgtcaaccctatttactgataacagatacagtaaatttgaacatgctctttgcttttccccactcaacatagaaacatttctaggttgtcaatgtccatcttaaaaagccatacctggaagttaacacaatattccaggtatgttttgaggggcccacagaaactgcaacctgcccacccattttcctcaggtgctttacttccagtaatgtactctaatagagaattcgttaaataagtcagcagcaatactgcattgctgatttaccttgagctttaaactaaatctcttaaattgtctttttaaattaaactaaatatctctagcttttgggtagtattgtttatttacttctattaaatttcattttgcttgctttgacccattattacagactatcaaacatgttaaaattggtttatcactgatcaggaactatgtaaatatctgggtacgtatgacagaatgaatttctacaaaaagtgattgttttctcgaccctgtccaggttatctgtaattctagtgtgatgtaaatgcaccaaccacatttcttcttgatccttttctctttcttcttttggagttttgtatgagccacttttcttttacattggtgaccacagaaagattgaaacaattagctaaaatgctcatctcacattgatcaataagcaggaccataaaagtacttgttattccaaaagtaaacaaggtagaccacaactctgcatattgaataatgcccattaaattcaaattaaaagctaacttcattattttacaaaatcacaagattatccattttccttactttttcaagtactgtgcttatcttgtgtcatttaacgtataagcattctgcaacgtgggaaagagactatcagtcaaaaatattgaacacctaccatatgcagaaatttgggggaataaaaactaaagtagacaaaaatcctgcctccaaggatctaacactctcgtttgagggaacaaaggctggaatgagaatatttaactaaatattgatacaccttgatacccctctaactgatccctgaaacacagctatacaagcatcccccagaagtaaggcagagaacatctgctttaccaaacacatacaaacaagttgccttgattttatttcctattttatctaataaatcattattccagcgggaagaaaacgtcaatgtagttgttttcacttttagaaattcttaagaaggcaacacaatccatgtaagccacagttggagaagccacggctctggcacaaacctgagaaaaaccctccttcaattaagaacacctcctcccccaggcttgaccctctgatcaggcttatctaaaacaaggcaggctgcctattacactcaccaacatatccaagctccttggggagccaactagccaaaaagtgcttatcacatcgactcctgcaagaacagtgggtagaatcttgccttatatcctacaaaaaagacaactcaaaaggttcttctcagaacaaaatgataggttactctcagaataaattccattttacatgctagaatggatagactgcttgcaaccttcagaatgaccattgtagtctttcaatcgtctacacattctacctctaccaggcaccctctgcgtgtattggtatctcctctggcaggagtgcggagaatggattgtgcagggtatcctaaaggccaaaaccagtgagggagccattgccatcaagggcatccaggaaaaagatgtctattgtgtccatgcccatagagttggagaggaaaaatagagaaataccactgagcaaaaagaaataggacttgatcatgtattggatgtggtgaatcaccataggaaaaaaatcaaagggtggtgtccagatttcaggcttgggtgactgggtgagtggagttcctgcttgctgtggcaaagagaaagtctaaatgaaaagaaaacacattcaattttgataccattgtgtttaaagattctgtggaatataagagtaaatttgtccctgtcttaaattgggtcctccaaaacatattgtgagtcaagatgtcatgtgcaagttatttatttaaaaattgctcccaggggagattagtcagaaagtgggcaaagcaagacaaggaagaggagcaagccaaactaggccttgatctgaagcaaaaactccacagagcacaagctttactctgatccatgggggaattctgatgggggaagatgcatctcaccactctccacctatggagccatggatgtgagcagctcagaatgcccctcaagagaaaaccttcacaaggtacgattagctattatcacttagctgtttgtgctttcagcctcagcttttagcttagaccacatgcctcccagagcctctagtgagcagcttagcacaggggcagtgtaatgtcttaccacttctggctctctacatgcagtctttgcacaggaacaccccattggactgacagactttcttagagctgtactgcggtctgaggcttattctttctcaccctccttccttcatcctctcctttacaggaatcaactcatcatcgtggtctaaaagctttctctgcctactcttgctccctctccccttaacctttcacaggccttaccttcagtaagatagtaataaggtaacttcaaactccatcttggcatctgctttctggcagacccaacacaaccctgaatacaagggagctggtctgtcatacctcgtacataacagtcactggctaatagctaacaataggacagatggggaagttggggggtggcacataggctcccagaaatctataactctccaggcacacaggcaaaagtgctccagtaatccagtaatccaaggacagacttctgaaaaagagctgaaaaggcaggcctcaaggctgaggaggaaaataaccaggaatactaaaagagacccaggacccaggggtacctaggcagtgcaccagcactgtctgccccatctagtaagggagctggatatccatgtagatctggaacacaggagagagatctgggctaaggattggaagataatggtgtgtggttgtcaggttaagactaggagataaggtaaccgaaatggaatacataaagagtgttaagggaagagagaaaacagccaagggaagaaccagaaagtagaccaccatttgagggaagacagaggagagaagacattagtgcaaaggggaaaggtagaaaggcaaaaggaaaaccagaagagagtgtcatcgaaaaagccaagaggagagagaaatccaaaaataaggaagtcgtaggcaatgaaaaatacttccaaggccaagcaaggccatgagagaaatgagttcagtggagagcatggggaggtgggaggaggagagggttgaacggggaatgaggtagggacccaaagtctccaatactctttcaagaatcttgtcactggattgaagaagaaaaacaaggctacagggaaggggactgtagatccttctcaggtcctttggggttagaggaacataatgggcttgtgagaatttcaaacaataacggtaagcttcatatggagaagcaaattcccatgacaactctgtccctgtaccagcagtgtctgtcagaagaaatgactctgctaattgtgtgccttcacagtcattgcactttgtcctacaaagccattatcgctaatattctgatgctttttactacttttacccactggactggtccaagataaaacaattgttcaccactgttcattttccttcatcttgtctagaagcttgtgtctacttgctgacagaaacaaaaatggaaagccacgagaactaaatacgtatttcttcccatttggtttctttgggaagcagaaaagatttgaaaattttagaaacattatgtttctttaagaagctccctcccaaaaataggctttgttattccagagggtcatggagaaactgatttttctggagatcttggtccagaagtaagttcataaaacagggaagaggcaaaccacttcttccgctagatcccactaaacaaatgagctgaatctgcccatggcccaggtttttttcagaaactggctaccaagccagcactgaggaaggaggctgcaagagcttcctgaaaggaacagaaatagaaagtggaagactgaaattgtctatcccaggcacactcctctctactcccagcctcaacttcccttctctgaaagtgacaggaaagagtgttggccttacccttgacagaaagttagggtgaggcagctgcacacctctgccctgatgtcatgcacatctgcctgacattcaggcaggaaatagcatcatgattgagagcatgaccctggggtcaggctgaccttgtttagagccctgtctctaccacctgttatataaacttcagtgagtttctttccaactctaaatcttagtttcctatttcttaaataaggacaataatgcctaccttaacagatggtcatgaggactaagcaaaatactgcctggaatatgtttagcacagtgctagacacataacaactgttcaaccaatggtagctaatagtattattatagaaactgctacttatatgtattgaacattgcctcatcatctttcccttttatgctggataatctccatttgcacacacacccccaaatctactccctgcccttgtctgtgccctaggagttgaccccagtggacaactttacccaggcttccctgttatcttacttacaccaagattctgctaaaggaacataccagcagcctggttctagctgtggcgggccccctcttttaggtagcaccccttccatagctctagctctcagtggtccaagtaacactgttcacggcctctctctggatttcctgtatgggggaggggagtggggaaagagagagagagagagaatgttctatcttgtttaagctatggttaatttgtatttcttgtcactaggacctgaaactaatcctacttaacatacccacctccattttcctgttcttggagatggaagatacacagaatgggacttggctattctggtaaagaactctgatggaaggatttcagggagagaagctagagattagatatctggcttttgttcaacaataaaacaagaggtctgggccctgccattttgacaggaggtaatttgcccaatgtcatttgcttccattgctttgtacttgtagatgtttgggcccctgtgtgcgttcactcagcaaagatgtctcagactgcagtcatttcaccttgggcctctctctgtcagtctccatttgccattgttctctctctaccccaaaagtgctcacaattttatcaggaattagctaggagataaatgcaaaccatcagtcttttattcaaatttataataaacaatgaatgttgagggttgaaaataaacacaaaactgacaatgactaaaaatgtaaaagcgaagtcaacattgaataaaaacagcgaaagaaccaaatcatcacaaaatttagacctgcaaaagtaggctcacaaaatgaactgagaaataatgtccatcaaaaaaaagtcagaagataaaaatcagtacaattgtatatagacagaaaactaattgaagaatcaaatctgtaaaatttaagtggaaaagaacttaggccaatgcaaataatttcagcaaaataaaaatgtaaattgaacaaaataggtatgctgtgactacatcatatggaagattgatggagagatttccattgggttgaagtgcctttcaggaatcgtgtcctcagtgaaagttcatcaatgttatggttcagattaaaatatgtatatgtataaaagtgtcctttgcatcaaaatagtaggaccaaagtggagggggatccaaatatcctgtgcccctaacacaatcctgaatatatgacctccagaaagttctggttgctgccatatttccagaaattctattttcccaagacataggtatattctatttgttttaatagcatagctacactttttcatagaaccacacacaagctttgtgaaatcacaagccagcctcctagagtctgtagctttatttttattttttaattcatactctcaaagaatcattgagctggaagggactttgagagatcatctggtataaactatccaggacagatggtattctgtcccctctttgttctccctggagcatgagagagatggaggagaatgaataagaaatgaacactgttggcagggaaaaacaaatgctctatatttgaaataatgaaaaaagggaaaattccaaactgctatttataatgtcaccatcaaattaatttacttgtgctaattattttgactggcctacacattttttagaaatagcacagaatatcaaaaactacaaaataaaattgttgtagaagttacgtattcacaaaatttattttatttaaaatactaggtagtgagaaaagatgtagagtgggtatagagaagtcacctgatacacctgtggtacagctataaacttccacaatatttggggaagattaattggcagtattaggagcttaaatgtatatatcctttgaacactccccccatgaagtccaattctgagaaaaataaaagtgcaaagtgctagtgcataggaatttatgtacaaagctgtttattgcattgttgtttataacagcaaaaaagtggaacctgtctacatgttcatgacaagagagtagtgggacaaagtatgatacattcaggtgactgaaagtcatgcagccatttgcaagagtatcttcaatctatctttattgcactggaacgaggtcaatgatattttgttaggtatgtgaaaaatttatgggaaacatgtggtactgtcttccttacataaaccaaccagaaaagctgagtgtgagtgacagcatagcttagtaatcagaactaccatttgaatgttgtgtctgctacacactggcagtgtgaccttaggcaaatcatgttacctctctgtgactcatctttctaatctatacagtaagatgaatacctgtaccgtctcataggatcatatgaatagtatactatatgtaaagtccttaaaaaacctgacatatcctaagcattacataagtgttatttgctatcattttattattacttatgtttatacaagcaaaagggaaaatatacaattcattacctaaatatctagcatcagttatttgaaatgagtagaattagaggaggaagcaaaacttatgaatttagtatagatactttgcttttgcttgaactcttgcaacaaatgtgtgttacttttgcaattcagatgactgaaacttaagagaaacagcaaggaagttttttttagtaaagtttatcaggtaaatttagaagtgtccccatgcacttgaatctcccatagatgagcagtgtggacagcaaagctcctggaagcctttttatgacaaagactgtgtctatccttctcccatttgtaaaagcacaacatcttaagcagttttactaccattattactaacaatatagttgtttggttattgcctcaatcacattaaaatgcatttttgtttctataagtgcaccaaaggtttggtaatttccattagcacctctgtagagagcagttgcaagataaaaggcaaattgtataattatgaaagcattacacccaacttttcttatcatttctattactttttagtaagcaaactttttttactgaaaagtctagcatcaagtaagtttggaagcctaaagcattttattgttgaactactcaaaatattaccataagtatagcaaaattatacattgcaatttaactttaaaagaataggtccactttgggaggctgaggtaggcggatcaccaagtcaggagatcgagaccattctggataacacggtgaaaccgcatctttattaaaaataccaaaaattagccgggcatggtggcacgtgcctgtagtccctgctattggggaggctgaggcgggagaatcatttgaacccaggaggtggaggttgcagtgagcccagattgtgccactgcactctagcctgatggagtgattgacagagtgagactccatctcaaaaaaaaaaaaattgctaccatgtgcttttgctatatttggctcatgtttatggtctataagcagtttattcattattcaggctaccaacttcattaggatttgttagaacaccttcaatatttctttttcaacattattggaggaaaaattatattttttatctttagtaaggcattttttgctacacttattatttcttggtaaggtagtgattggtggttttttaacatatttaatgtagtgttagacaccgttaagaagtacataaagtagaagggaataaaaccaacagtcactacaaattttcaggttttgaaaaattatctttacctaagccaataggggacccagacctgccctgtgttttccttgggtacctactctgccaggtggtaagctggggtggtccctggcccagtggagctcatgtcctaatgggagacaaacaaggaagcggatatgtaaacaagacaattacagccaataagtgccatgaaggacatactaagagtgattataaaggaaagtgacctcacagataagatgggtggggaggggtgtgcaatgacgactgttgaaatgacatctgagctgaaaccagaagggcaggagtgaaaaaagccacataagagggtgaggcattggaggcacaatgagaaaaacaaggatgaggtgatctttaaaattgaccatttaggactagtttgtaatgataaattattctcacttctttaaaaatgatctatttcttcagcaacatggataaaactggagatcactgtgttaaataaaataagccaagcacaaaaagacaaaaattgtgtgttctcagtcatctctgggagctaaaaaagtggatcttataaaatttgagagtagattggtggtcgacagaggccagggcaggtatggcgaaggaggggatgaagagtttgatcaagggtacaaatatacagtttgagaggaaataagatctactgtttggatgctggcaaggctgtggagaaataggaacacttttacactgttggtgggagtataaattagtttaaccattgtggaagacagtgtggtgattcctcaaggatctagaaccagaaataccatttgacccaggaatcccattactgggaatatacacaaaggattataaatcattctactataaagacccatatacacctatgtttattgcagcactatttacaatagcaaagacttggaaccaacccaaatgcttatcaatgatatactaaataaagaaaatgtggcacatatataccatggaatactatacagccataaaaataatgagttcatgtcctttgcagagacatggatgaagctggaagccatcattctcagcatactaacacaggaacagaaaaccaaatacctcatgttctcacttataagtgggagttgaacaatgagaacacatggacccagggaggggaacatcacatacaggggcctgttggggggtggggggtaagggaagggagagcattaggacaaatacctaatgcatgaagggcttaaaacctagatgacaggttgataggtgcggcaaaccaccatggcacatgtatacctatgtaacaaacctgcacattctgcacatgtatcccggaacttaaagtaaaaaaaaaaaaaaaaaagatttgatagatcagtaggtgaatctagtttacattcatctactgtatatttcaaaagaggtagaagagaataaattgaaggtttctagcataaatacaaatatttaaggtgatggatatcccaattacacccatctcatctttacaaattatatgactgtattaaattatctcatgtaccccctaaaaatgatcagtttaagagtctagtctcagattttgctatctaaaatatactatcatacattctggggtaaattgcctttaatacttgatgtcctgctttttatctttttaaatacagatttttttcttttaattgcttacttacaaataattaggaagatattcacatgcaaatcgcataaagatgtcagagaaactccctagtccagcttcctccaagagtatcttcctccaagatactcttctgagttgtagaattttaacattaataaaaaatgaaccactttttactctggcaccatgctctttcccccttgcaacctcactcattctctctcctattcatcactagttcatttttcccaactctctatcagatttggcactcactttttatttaccgtttgactctgcagacccatttaatttgctgagtcaccttggacttcagtttctgcacctataaaattatgtggctggcctagattatctataaagtctttttcaagtctaacatttttctggtctacaattcactatctacaaaccccccacttatatatattatcagtcatctctccacctccttactccctgagtgtgttggcctgcatatgtctggtgcctataatttgaggatatgagtctgtgtgaagaaggtgatgaaagcaggtggaaggagggtgttgagtgtatgtgagctccacagaggtggcaggacagcagggagtcagtaggggcccatggggaattggggtcagcatggatggagctacgggacacttcaatttcaattactacctccttgaaaaatgaagctactttacaacatgatctatgactttaagtaaaaaaaaaaaaaaaaaaaaaaatcctcacaaaccatgcgaagacaatctgtacacattcaaagtgacatactgatttgtcaccagctggttgacagtaagcagtgctgaccagaagtgataggactggctaccctgaggcccttcatgtcaccttagtgtctgctgcccacgaactgcctcccttcataaagcaggaaggctgtgctgccagtcacttactgtccctattgagcacagtacagtatagtcattaagaagatgagttctgggttcaactcccagctctaccatttatttgttgtatgaccttaactaagtcacttgaattctctaaacttacttcataggttttatgaaaattgaatataaaatatctggcatatagcaagtgtttaatatgctaccagttactactgttgtatagttgataagactttggtgttaattaacttgcatttgcatctgtaagtatgaaatgaaagcctgtgaacaattttcagatgtcaacaagtaggtggaaagacattttggggcagaagattctgaagcatgcgacaatggtagcagtagtagtagtgatgatgatgatgatgatggtgatgatgatgatgatgatagctaccacttattaagaactaacaaggggccaggcactatgaggctggctggaatgcttagctctctcgggtaggacaacacttaagtccctggtccttctcagtgctgggtgatgaatcagaagctggagataggaatgttaccaagagagaaggggacatagaaccaatgagaaagaaacagcaggccgagcgtggtggctcacacctgtaatcccagcactttgggaggctgaagcgggagaatcatgaggtcaggtgtttgagacaagcctagccatcatggtgaaaccacatctctactaaatatacaaaaaattagctaggcatagtggaaggtgcctgtaatcccagctactcaggaggctgaggcaggagaatcccttgaacccaggaggcggaggttgcagtgagctgggattgtgccactgcactccagcctgggtggcagagtgagactccgtctcagaagaaaaaaaataaaagtaaagaaactgcaaagcattagagtgggtgctttgacagttaatggactagttcttcaaggatgaatgagagttttccagaaggaaagatggggtaacagtatttccagcaaagagaacagcagtcccaaggcaaaaagctgtggatggcctggctgttcagggaagaacagatgtttcattgtgtggcatagacttcagagacctgaggacagatctggtaagaagaatcttctatggtaagcaaattggaaggggatggaatttacattaaatgagtacctacgatctgtcaggtgctctgggtacttcatatacatgaactcagtaatccccaaacatcctatgagtaggaatcattctctctctcttacagatagggaatccaagttcaataaaggttgacatttccagaatctcacagttacttagtgcagaactggtgttacaccctttggtgttcctgactcctaagcccatgttcttcttgctgcccccacaacctcctcttgtaccttagagagttctcgaagaaaggcgagcccacttggcttctcctgttagtcagttgccaggtggcaactgactaatctattgataataatgttagtaatgttagacatcctatacaacggcatggtgttctgtagattacaaatcatttttggtgtgtggctttgggcaagttattcatctactctgtgcctcggttttctcatctgaattacgtggtacccaccttatatggtttccatgagaaaaaattaagtcataggaataaagtgcttagaaagcccccgaacatagttctgtaaatgttggttccagagttgccactagtttcagcagctcattcaggttttatatataaggtactttctccattttacaggtgaaaaaacaggctcagagaagtttgtaaactgcccagacacactgcttcagagtgacaagggaaggattccaagccaggtcttctgactcccctccacccatcctcttctgttgtaatagtgtatgtccacctgttcacctacctccctcaagtgacatccaggggcatttgaggtcacatacctgtgttcagagtgtgcaatgagcaggggtccctcctcatgcatactgccaatctcgaatgcacacaccaaataaatggctagaagcataatggtttcccctgtactaccacatgtgctactctaagtctacatgtactaaaatagccagaagcattatattattttgtttaaaataagcttccaggagagatgaaatcatcaagaattaatgtaagtgaccatcttccaacagagatggtgctaacaaatgatgtgagacacagatcagtgacctcttcaattaccccagctccacctgaaaagtccaagtcagctgccaaagcacatttatggctctctctggacttgtgcagtcactgttgtgttcatttactttagcctttatataattagcccacagatagtattagatggtgataatgtacacgtgcatcacactccgtttacaggcttgtagtgaaggctgttagtcacactccatgtgactacaaccaaatctgtcacacagtctaaactgaccaataaatccatgtcaagtggagagaataatttaagtgataataaaaggcaaccggtttagattttgatcttattggcataagtttcctgctgcctaaatgtcatttaactcttgagggaacagcgatgagggccctgaaccttccaggcgtaagtttaacagtggggattaaaagagatgttagcctcctgaagataaactaattgttagatccaattttaaattaataagtgccatcaatggcggagaagcaactgataggatttgaggggtccttggaggtgcattctgtggacgcagttgctatggtgatgggtttgttctccaggagacagaagctggaacacaggatgcttggaagtaggatgtcattgtccacatgaagcacaccctgacttatagctatgaagcttccagggtcccaccaaaggcgtttttgcttccagcactgccttggcagatgcagcagcctgtgggctaatgccattgatgtccggcaaatgttccaggagtggtgcctagcccagcttctccctctgttaggtactagaaagagcagaaaattgcctgtgcatatggagaggaagaatgggtgaacaggagccctgacattgtgatgagacgtgtgaattcatttcataaaattcattctgaacactgatcagaacacacatcagaagaactgatgttcttcccaattcaaagacaaaacatgatatctggctttttcaccagtccccattcaatgtttatgatatccaggtgacagtatcatggagtcacttccaaatctgaggctggggagcagtagttagattcttaggtcagtgagaaagggaacagtggcagatatttaaaataatggttggaaacccctgaatttgcaagtcagatacaatacacccagttttttacatactgttcaggtattcttatgcatattaaagttcgagaacctgagaaaaattaaaggactgttgtcctacttttacttgtgtccaagataccccattcccaatgcccctgctggatccttctcatctctacaatcctgtaggttggactgtccctggttcagacattgagccttagttctcatctgtttatactcactccattgggcaatctaatcaagtctcacagccttaagcccatccaaaacccattcacatcctgaccacttttaaataggtatctttagcctggacatgccacccaaataccagatttatatatccaactctctattcaacacctccacctgaatgtctacctgccatatcaggcaagcccaaaactgaatctctaatatttccccctacaatcctgttcttccagtctcctacatctcactaaataattccattttagttataggagccaaaaacctcggagtcattctcaactcttatgccccacatctaatccaacaaacgtttactctgttttcccaaaatataccaacatgtgtacctgtcagctcaagagtttattcccctagacatatgcctctctcacttaatgaatattagtaggtgcatttgttgtgttgtggattaaatgagattatatttgtcaatgctgtttgggaccgggcacatagtacatacttgaaaatattggctggatttgaatctgaattttgttgatcagactcacattcatctgtagtatttttgaaaagcttcagagaagcccttagctacctctttgttgttgttcctagttggcatgtccttgggcttggtttcaggacccttcatgctgtggtgatccgactgatcatgaaatctccatgaggacagagaccatgtctgctgtgctctctgttgtgccagcacaaggtggccaggtacaaggctcactagagaaggaagactgcttgtgaatgtgtgagaatcactgggataagaatgagccctcagcatctctaaatggtgtgcctttttttatgtttatgagaatgtcaggagtggatgagatatttacctgcatggcactgctacaagaaccatcagaccatgcagcttcatttccaagtgccactgtgagtctggcaggattgcttacgacagctccctgaaggtgtacaatcttcagtgccacctcatcaaacatttagcacttcttcaattgtgctaagaagactgacaatagtgaactaaaaatgtaaatataatatccttgttaatgaatcatgcctttttgtggtgattctcagtttaaaaaaaacctgagaaagctagatgaaggaaagtcatgacatattaatgatttcaaatgtgtcctggaattggcagaacagaaagtggcatgaataattcaaataagacaccgatttttttccccttcttgcaaaaggttaaagcgtgaaaaataggggagggggcttctggaaagacaggcagatctatcgtgtattctggcgatctccttgcatttggagggttaatagaagttcaagcaacataggacaccatcgagtcattctgaggggattatattgaaatcttttgacaccatatttagttccttctgactctggcagctgctgaggagagttaagactgaatgtttgatgcccagtgaattagagtatttttgaactcaaatctccaaatcctgaaggaatggccactgagaagaaaggaaagcaggaaagagtgctgggggcagttgatttagtgccctctctccttatctctaccacgcaaatgatgatgggagtcggatatgaaatggcctgaaaggaagcttcgagtatagatgatgtctgtgagtaggccacaaataaaagccaatagagctaccttttgctttagtaccttttcctcattgtcttttcccctgaaactacttttaaaagcatagctatagtgttccaaatgaaagcggagtttattttagctgtgcatagattgtcatgggttaatattcatgagtaagattttctatcagatggacataatgtagatctgtgtgtgtatatatatatacatatatacacatacagatctaatgtgtgtgggtatattttatacacatgcatacacatatacataaaacatatgcacacatacaatgaatatatttgaacagtgcagcaaagaatgtttttttaaaaaactacgatgagtgtgctcaaggctcgaattaataaagaatgaggatttaagtgattagggcaagatgaaatctcaggaagtctatgaatttgaagttctctttcagaggttcagcagagaagataaatcaataggtacttgagtcaatccgtaaattatctgttgcaggttgtcttttagaagttggcccaaagggattagaacaaagggaaaaggaaagaaatcagcccacagaatcaggcagcagtctgcagctgggaaaaggacagtccatccatctatctatccatccatccacccatccacccacctgtccatctgtttatatactgagtgtatacgaatgccaggcactatgcaaggtactgtggatatgaaataaaaaaccagaacccttcacttcactgaggtctcagcccagtgggtgagagaaacaaggaaacctggaacttgattatcatatgctgagctatgataagaagggagtagcaggctctgggtatgcaaaaagggggcaataattattcatcacaaagctatctaagattccagacttttaggagtcagaaagcaactcctttctgtgaagattaagctacatgaaagctgaatttcctattttgtttatttacaccatgtaacttatataatcatttataatgttttagaggcattttccatgtatctctccatatactaagaactgacataaatgacttttttcctgcccaatcatagctatgtatagaccattcccaaatcaaataatacttgcagatttttatttgagcccctaccatgtgccaatccttgtgctaggaagctatcttaccctcacaatgtatactacaaatacatacattttatccactaatatcgtgcaacatatgacacacaatcagtagggttagcctagaaataaattaaagagtgtctaattcatggtggcctgcaagtgaaatgtgccccaaacacgtagtgttttgcttagtttaatttaaatgtttatcttaggtatgtatggggagagtggggttaaggtttcacatctagtgtttcccagggcaccctcttgtagccttgtccaaagactttgagttaataatccctgaatcctggtgcaagcccttccttttccaagggaggaaaaggaggctggggaaaattaatttacttcccaaagtcagtgctcagtcgtccttgccctccaggactttggcatctagacattgttggatacagtgggttctagatttctcttcgaagaatcagtatgtcagtatattcagttctttgtcctccattttaaagtttaacttcctcgtagtttcagtaaacaatcttttccaccagttttaagcagttcacatctgttcccctggtcacctgctccatcctgactcatcatggtcaccttctttgacctgagtcacccctggtcacctgctctgacctaagtcacctttagttacctgttccataacagtcttccctgccaaactgctcacgctgccactctggctcatacccccggcactctttaaaatagccaatcagaattagcttagactatgcagtccaaccctagacaataggggaatgacacagcagtaggggctacctgtttctgcaataagaaccccttcccctcccttgttcaggtgggctcttgctattgctccatctgcaagctacacccttctatagaagtaaaattgccttgctgagaaaattaaatttacgtttgagtactatttctgtgcagcactgaggaatgagcatttctaacaacatggagacaatttaattcctatgaaccactccaaatgccacttgaggcagccctattgggttctacacccagccacatcagaatcaactaagaatcaactacaaatcaactacacccagtcatatcagaatcaactaagctacttttgcttaattggctgtcttctgtgtgtatgcttttaaaactttcttggggggaaagaacaagaatatatgcacattttaaaagaatcaaaccactcaaaggggtatataatcaaaattcctagtttcctatcctctaggccaaacccattaacaattgttatgtattcctctgcaacacacccaagatcatgcagcttataagaggcagagccaagatatgagttcagctccactttagagtctgtgttaagttattctaaactgcctctttgggtatcttagtctgtttaatcaaatggtcaatttaattttttaaaaaagatggaatgacctagacaatagaatgttcacttttcattgaattgtgttgctttaatctagatgtagcaacagtgggtatcctttctgccatcaacagcattggagctacgttctgggggatgtgtgtcttgggtagaaagatcataatcactttcagatgacattttcctcagatctcttggaaggttggaataggaagtgggttttgtcactctgatattctttgtcagaaagaccttatctaacctccaagaattctaggtctccaggaacatgtatagctcaggacctaatccatagagatggtctttcctggtgtgagtgtaaatgaatgtccttgaggccattcacttaatttaactcaggtctgaggcaggactttgaaaagcctgagtaacccttggagtgtgtacctaagtgtgcctgttggtaggacaggtgaggagggttccgggtgaagttctgaggtgagctcccacaagaagcagaagacagatgactgacagagtggctcagtgagaagaatctgtttattcacatggttgaggaaacacatcctgcacctggatggggtctctaggatccattgtatgtctagctcctcaacagtcctcaagttccaatttagtgtctgctccagaaagcagaccttcaatttcctcatgtataaaatggggatattaacagtacctaactcagtgttttgtgaagattaaatgaggtaatatatgtttttgtgtgtatgatacatacatacacatatcacttagaaaaatgacacattaataactgatatatgcagaagctagttacactgtttggacaaagtctttcaaatattatttatttcaaattgtttttcctagatggacaagccccgggacagaaaaattaaagctaattgtattgtaacaggaggggtatatatgatatacattaattgcatttatccagcagttcctcgctcacaaaaagcacatcaaaattgttcatttcaacacaatatagtaggatataaggtataaaataattactttgggcctcaattttgacagaccttataagaatcttacttttaaaatcgctaactcggtgtgaaaaataaaaacaaagtttaaattgaacactatctcatattccttcatttgaggtttgtttctctctttttatttggtccttttgacaggatttaatggaagcaatggaagccaagaagggtcataaggcattaactgacgaggaaaacttgcacagaaaattgtaggaggaaaggacatttcattcatctctccccacttggcacagtgccctttccccagaggcaaagtcactgtgagagaaatgagtctctgcctggtgtgggcagagggtggagagacctagaatctagtttatatttacactgatatatactcactcaatgtcacatctgtgattctattattaataatatagtagttatagtcccttattcattgctttaagattacggatttttttaaaagcatagagtggctattttaaaatgtattaaaacatctcaagtgttttttaaaaatgaacagccatagttttttttttatttacttcaatttaggaaataaaagcttatttaataaaaaaatgttgtaaaagtgtacatattaacattataagttcaatagagttttcctaatttatgttactgcaagaactctaatgccaattagtaaaaattatggggtcttaatgaaacatgtgttgccacatcggaaagtgttgcaggcaaaaggaaggtgtgttcagaggcctatagggtagagagagcaccatgtatttataagaggcatataagacattctggttggactgaacagagtatgaaaaaggcaggaggcaagaactgaggctggagagaacacctatcttgatggtcagtcactctgtgtacaagtggctctcaaaatgtgacccagaaccaggagtgccagcaccatctgagaacttttgagaaatgcagattctctgccccatgcagatctactgaatgaaaaactctggaggaaggcccagcaatctgtgctttatacaagccctctgagtgattctaatgctttggttccaaaggcctgaaaaccaggagtgtagaccgagctgaaagatttctcctgcacattacaatcaccggggggactttgaatacagacatctgagctccacccaagccagttaaatctgagagatgggctctagcattggtattttctgaaagttcactagataatttcaatttaggaccaggtttagaactactggttcagactaaagtttcataatctgtaacgcgattgggatatagtgtgtgccaaaatagcactcagacccactgtttcccaaaactggagccaattttaaaatgatttttcagtggggtcattttaccttcatttcgtttctagtaacaacaaaccttttctcagcaattatgaacccagcaagattgttgaggccagtgctatggaatcaagcagaacttggtctcttctctcccagagcatgggcccccacacccttttctaatagcagcactcagacgagcccctgttcccatttcacacgggtcaaacacactctatatatgtttgttttttgttgtggtggttttttgtttttggggttgtgtgtgtgtgtgtgtgtgtgtgtgtttaaggccatacagtcaacacactttatcaaatcccctccatcccctgaccagtggtctccagataggggagcccagtaggcacaggacttcccttgccactgacagcccacacatgcaagcaccccaaagtgaggtcctggaggaataagcagtggaggatgccaatagtgtgaaaagttgtctcatttcttttcagcatccccaggcttagctggaaacttctttcctttctagtgagaaaacagactctgaaggggcaggcatttcccattagtcctcaaaataaagtcagaagaaatgcaggagaggttttcagatgattgattgcctgctcaggttaggcgtctccttgggcttcttgccttcctcctcctgccttccagtctccatgctactctgcagagggaaaagctctcgttatcgcctacatttcctgggactttaatccagagcagagaggaatacgtttacctgggaaaaggagcaatggaacaccttcctgctttacagccacctcccctccaaataatgaactccaatcccagtcagtagttaatgaaaagcagagtggtatgagcccaattaaacccttagagctcctgcatatagttgtacaggttgcacactgagcaactccatagattgcaaagtgaatagcaccttgaagttgtgcagcacataatctgcacagctatacgtgacagccctgccaacactgacgctttgctcaggcaaataataaagggtaatactgtacattcactttttccaagacaaagtaggaatagaagaccctgctatacaaaattttctataacggtgctatcaagacttctaagttattcaaattctcatctgctcaagaaaatcagatgtctttctgaataaatagaatgcttgtttatttccttccttgttacaaatctgaggtggtttatagttatatttatatatgtacataggttcacataaatagaattgaaagattgaaacagtgaaaaggataaagaaattatgctaaccatggaattaacacacttactataaacattatgtttaaatttaattaagtcttctggaagcaaaggcaaaatagagaaataccataattacataattcataggtaatagataaaaacatatgaaaacttaagagcataactccttttcctgactctcaatcattaaagaaatgtatcatcatgaagctaatgtactttcccatcttggccagagagcaatggtgagactgggtgagagggtagaactttgatacctatgtctaccaaacctgcccgatgtctacatcggtcaaggtttcaggcatttaagccagccagttaggttcaaatcccagctgtccttggaccaggtgcttagcatggcttcagttttctggcctgtaaatggaggtaaaatgttacccacctcatgatctgcctgtgagagtgcatgaaataatggcaatgatgtgtgtgttaacacagcatctgttccacagtaagccctcagtatatgtttgttctcattgttgaagcttgggatagtagagggggagtgagaacttgtagcttagatcggatgctagagctatacaccaagatgcccaaagcagacaagaatcatttaaaatcaaaggacacatgagatgacagggcaaagaaaccagagtgaggagccttttgggggaatcctgagatgaccagcctttgtacccaagaatttgaataacgcccagttccacccctcaggaaagcctttgcttttctttaaagcatcactttgcaaccagtgggtgacatggaaaagaaataactattaggttagcaatagttttgctacaaatgcaaaaggaacctgtacgtgttgtgggttcttgagtcattcctgagtgatgatcagggcatccaatgatctggccaggccggagactcaggccacagcctggtgtgcatggtgggtgacaggatgagggaggctgacacaggtagtgggcatggggtgcacaggagccatagtcctagtcctaaatcgttgacctctggaaggaaagagtgtttggaacactgagtccaagaagtaggcacaaagccagcacgatccccacagggaaatgtcttttatggggcctgacaaaaaagaagtcaggaagtagaggacagagagctctctcaattatttgtccaccttttcagcccataatctataatgagaaatatattctacatcacatcccagtacacaagtacacatagaactaaacaagagttccaccaaacagttcttagtctcaccacggatgctgcattctgacattatcatacccattctatttttttaatgctgttttatttcagttttgaaaatattgctttaaggaaaaagttggagaaaggcccactttgggggaccctaggtccaagccagtgaaagagaagtttcattagaacacttagcaacagccaagggcctcaccctgtgtgactgcaaattaggttaaagagtgagtcccggccaggtacagtggctcacgcctgtaatcccagcactttgggaggctgaggcaggtggatcatgaggtcaggagattgagaccatcctggctaacacggtgaaaccccgtctctactaaaaataccaaaagaaaaaaaattagccgggcgtggtggcaggcgcctgtagtcccagctactcgggaggctgaggcaggagaacggcgtgaacccgggaggtggagcttgcagtgagccgagagcacgcaactgcactccagtctgggcgacagagcgagactccgtctcaaaaaaaaaaaaaaaaaaaagagtgagtcccatgaaggacttgagtcccacatgtataatacacagtaggcattcaagaaacctggaggtgtatacctactgtgtacccacaaaaattaaaaatcttaaaaaatagaaaaaggaaacctggaggaccaggtggatggcgtgtctcatcatcttcacctgggcttttgcaagttcttaacaatagagtcaagatcacacgctctgctgggacctggcacactgggcctctctgaagatattctaaggatgttgagtccaggttcccatcagctggaaagagctgaacaactattaatagttcagactattaataactgttcagacattacatgaattttctagaagtgctttcccttcgactctttcctctttctgcagtatagaactttcttccttttcctcacttcatgccattagacttttcaaataaaagtgttatggtacttttttcacaagcaaataagtgctctggctattccagaatgctaatgcttatctaaaaggaaaaaaaaaattatgagacagttctacctcacatctgcaatttccatttgaagcaatgcagtctttttcccctcaggcccttttcccctagtgctcccagagtaggttctacaagagaccagaattttcatttaaggaagggctgcatggggtgtttaggagcaagccatgcccgaactccagctccacccccgggtcaagttactcaactttctgacattccatttctttttctggaaaaggatattaataagtaacttgtggtggtgttgtaaaggtcaagaacaatgtacgtaaagcaaaggagagggccaggcacatgaaggtgctgaaaagtcatctgaggaaaaggaggagttgttgtcaagtcgtaagtttccttttaggtagacccaaagaaagcccagctcatttcgacagcaaccaaacaggaaatggatcatgactgtcgtcatcacttatgaagtatttatgaggcagtctactattcacgtcactatataaacatcattagacccagtgtctatccaataggaaggtctttaagatggataacggatgtgatgtgataggattctgtgtgaaaacttaaaattagcagtttacaggaagtgggatctagacaactgccttcactggtacagattttatgcacagatcttttctgttctgctagattaagagccctcccacctcactccaggtcacagactcttttcatttgtcttcaagttctctccaacccctcaacttactctgctccctgtacttagaaggtattaatatttagcaaaactttcctagatggataaatattagaccattccatgacactgaacacgaaacctaggttatgctttggttggtgattcgggataaagagcaaacgccaaggccctttccagagacaaccccctgtgttctgcccacaagccctaggaggaagctatgtgatgaatcgtttttcaagtcagagctggtaggaggcatatgtgagaaagacagggcctgagcctgtcgtcagggagctgcgtgagtcagtgtctattgtaagcaacaagcttcttggtaaggggctctctaatgaaatgagattttccaggccacgatttctggacagctaaagaagaatctaccttgagggatgatgtcaaccaaaactctttaagaaaatgatctgttgtagggaacatttgtatcctgaaaagggactttatgttctgcttgcaggcaaaatcttggttgtataaatgtatctgtttgcttttcggctggattagaccattcaaggcattgagattgtaaagtttgacataagataagcagaataaacaaacccatcaagaagaaatattcaaatggcttcttctcactaatgttcactgtcaaaattaaatctcagagcctgtgtatctagttgttttcaattagttatcttccaactaatcacaagtaaaagagctctttcattgcacttttacaaagtatatcaatgtttagttgaatttaaacagcacagaaaaattctctgaactgaaaacagaccagtcaggcaaggtgaatgcttccttttgctgtccgaaattcaatctgagggtatatgaaaactcatcatgaactgtatttttgccattctaatacacacttttctttttgttgcacaatgcaatgtttactaaatcagtatatgtcagatattctatatggacaattaatgtgtttacttttctatgaaaaaaagaggccatcaccaagccaatgagagtcatatttgatggtatcttagaatttttttaaaaagatacttcattgctttcctctaagaattctgtgcattactactgagcttcctctcaaacaaccccatcctccctggggtcctggaataatgtagatgtggcacatcacaaaggtatatccagatagtgttctccctctcttgctttctctttctctctgtgggtgggtgggtgtgtgggtgtgtgtgtgtaagtaatcgggaccagttatataatttgcaaagcccaatgcaaaatgaaaatgtaggacccttgttcaaaaattaaggatttcaagatagcaacagagcaattaaaccaagtataggactcttctgagcacagagccctgtgcagctgcacaggtcacatacccatggacctggccctgctgctgatgaacagagcaggtggtcctgagcttcaaatgccacacaagtcctcatatgctctagaagccctccctcactgatacttcagctttcctcaataccatcccccagctaagtcacaccatacatttttgcacaacctattctatgtacactcaagtaatctactgtgtcttatgaaaggcagggcaagtcccttgtgagcacagtgaagcctcaggagatctcctgacatggatctgggtgatatagtccccactctgagccctaggcagtgtcagcttttcttcattgattcttctttctggtcacctttgtcctccttctcggtccaggtatcttctgctttagaattagcatctctctgcctcactcccaaggctctttctccccatcccttgttcaaatcattgtatctcataaacccaagagtgcactcaataaagatttttatcatgattgcttgatctgtaagtcagaagtcttctctatgtgaaccataatatggatcagtttattatcaagttattagatcagcttctgggccagcctgtcatttactggcagtgtggtgcagatgcctaagctgtcttctgctggcattattctttaatttctccccctaaaatgttcactatgaagccattggtttaactcaaactaatgagttcatgatatttttttcctgagactgggactttgatttaaaaatcactttcaaaacccttggcgttttaggggagacagtattaaggaacaaagagtctgagaaatgcgagaacccagctctgaatgaatcccattttcccagaagcctccatgtatttccccaaacagggagtgacctgcaattccacaccaggagagcacttggtactaaaaagaatgtgtgatcatattaactaattgatatactccatgaaaatcgctcaaaacaatcctttgacagagcaagttggggataattggaacctcaaatgtcactaaaatctgatatctcacaaggactccagaattgaactttgaaaaactattagtcattacagaatgtcctcctgctgctgcagtggcaaaattttcttttctgaatctatttattatctactgaggctgctggcttatcattcttcacaaggtatggagataatcaaatgagcacatgagtatagtaagtgcttggcacaattcttggaacatagtaagcactcaataaatgttagctcttattactacatattcccttattttgaaatgacattaactactgtgacaactaaagtagatcagggtcattctgctgccatgcaaggcagtctcttcacatgggtgctgctatttacaccatccacatgttactttagtttctagctaagccaagaaaaaagattggaacttaaagcccaggtcagccacttactctacaatgagtaatgattcttaactggagcaattttgcgcccctacccaggacatttggcaatgtcttgagatatttttggttgtcatacttgatgggtattctactagcatagacagaagccagggattctaaacatcctacaatgcacaggacagcccctcacctcacaaaaacaacaaccatttaatcccaagtgtcattactgccaaggttgagaatttttgctctatgagagaccttgctggaatatttaatcttactggtcctcagtctcctcatctctagaaaggagaagaaatagcatcctacttgtaagcttgtcttaaataaaatataagtaaaggtaaatgaaaagtgcactgtggagtctctggcacagaaaaccctgatggttacactagtagtaatagaagtggtggtggcgagtactgcagtttctaatacaacatgcccctccctattcacaccacaggaatgagagagtctctgaaccatataagctctttttgttatccaaataagaaaaaaagtaaccgaaacctgtttacttcttttgtttcttgtattggccttttagaggtttctaaaaaggctcctcaatgtttcccgcctcctccaatacacaaaaatcccagttgtccagtgacacagccttgaaacaatgtttctgttctgttagttatttggttatcattgacactgggtctctgccttaattaagctaataccttcacagaaaaaacatgcaacagtaaggtacaaagtctcagctgtgcagagcctggtgagcagtctgcatggccctgctctggagttacttctccagcacttcaaagaaaatgcactgatcctgtatcctgcttagctatagccatgtatgtctgtgacttcttgatactgctatagactatttcttcagtatgcagataccattgctttggaatgtgttgattaaattgatcaaaaaggcatagctgaggctgatttggcaatctctcacctgattccatatctcttgtcagtaatgttagacaacaggttcctggaggaaagaactttggaaagttctcatgtgagcagctatataggcccagtttggagttttcctctgggatgcaaatgagttaccgcaaatccttctaggtcccctgaaaggaggtccccatttatctctagaaatgcgtaagccagcttgccctttgtcagaggggagagctgagggagaaagttacttgctatctaatatgttgtttcccaccaggaaatgacttaatattaaaaacaacaacaacaacaacaaaaaacatgtgcagcctcatttaacattcattcaatgacagtaggtttaccaaatgccaaccatgtttgggacactgtgctaggcccaggatacaaaaatgaacaagccagtcgctgccatcaggatgttcccagtatgctgctctctcctcctgcagttccttctaccctggtaccccctgttatgaaagtgtttacccaatgctttccatggagcttatctaacctacctgaaaccgtctctttacatatttttatcacactacttcctttgttcttcaaagttatttccaaatataactcatctgcaaaacctgcaccaggtaatgggcacgctccatttatcccacaaactttcactctcttcatcaatcccttgccatctccttcatatatttataaaatgtaacttacaaattcttttaaaattgggcctatttgtgacattaattaagcacaagtcataatcattgatccccaacaaactgtggctagaagggtcagggagaggggcaccaagctaagtccccagcactggttgaagagggcctggagaggactggcccagttacagaaagtgcccctgagagggcatctggacagcccatgcagagtgcccaggggcctaacttccagtgtctgctgctagcatatccagcaggtgaactagatacaacaactggaagtcccggcagtctttgaaagatcaaggttagacatgtggcagcggtctttggaggaaacctgtccatgcatagcaggattttgatccactgttcttacatatagggtcaggattaaaaaaaaaaaaaaaaaaaaaaaaagctgggaaaagctagccctagaaaaatacatttgaattaaaagtaggataagaagggaggcaaggtgtatataagcaaggccactgctccctaagtgagaacctagaaaaaaatgcaatcccaaaggctaggccagttccaattaggatatgactcagtcgtacctggacccactgggcacacctcttgaatatatgggcacatgtctccttggaaaccataactcatgaaatagaagcagggatcagggagagatggtgaagagccctacaatggcagcagtatctacggagtttaaggttgggagcaactttgtgccaaccccagcaccagggacaaggctgccattgatgtacaccctacattggaccaggaaggctcagaaaggagcccaggccacagactggtttgtgctctcggttttctgtgcttcagagtcaagcttcagggcttgacaaagacagaagtagaggtggagaaaacagcagacaggtagctggtttgtatggctttagacattcagaggcagaaatgttgaacttgttggtttgacatgccagtgaatctcctgtacaagtctgaaaggccttttagtttataggcacaacttctccatgctttggaaaatcccatgtttgctatggctgataatgctagtgaagaggaaaatgcatatattaaattacacagtccctgcaaattaagaaaaaatatagctacagatgtattctaatgcttctctgaaacacacgtatagatgagtcgtgaaggttgacaccatccccaactatgtatgatgagtaaattaacttaattgaatgtcaaatcatggtctttgtttttcacactctaaaaatagtcaccttagtagaaagaacacaatgtgcatcactatgaaatctttggagatggttccacgaaaaggccaggaaactgccttccaggcccgcatgagcttggtctgcacaaagtgtttagagagaattatgtgtttaagaagctctggtgagtgtagttcaggaatgctgacagccctaagcatcttcacttattaggccagttttactttcataaaaatcctccctggcatacctgaaagtaaaaatccctcctacttggaaattgaaatctatgcaaagaaaagtgctgtctccccatctttgtccatgacagaaaacttggagtcatgtttgggctcagaagtgtgtgttaatatttatatatgaggccaggcgtggtggctcatgcctgtaatcccagcactttgggaggctgaggggggcggatcacctgaggtcgggagttcaagattagcctgaccaacatggagaaactccgtctctattaaaaatacaaaattagccaggcgtggtggcaggtgtctgtaatcccagctactcaggaggctgaagcaggagaattgcttgaacctggaaggaagaggttgcagtgagctgagattgcacccctgcactccagcctgagcgacggtgcaagactccatctcaaaaaaaaattttacatatgaaatctatggacttcttcagatatgggaggggtactgggctccagaagggtttatactttacagttcttttcaaaaatattcttcctaaggaaacagatggtaggtagcttcctttatctacatcaaagttcaagagcagtcaattactcagattatgctgaagataaacagtggtattctgttcagttcttgaaataatcttccatttaaatcatagctaattactatttggctaattaaattcattgagtacttcaaaaatgtctatttcactgtcagaataaatgctttagggattccctgttgtgaggagctttctttttattacatagaatactgagttggcctgaatctgtgacaaagaagtttttttcaagaccccttaaacaacacaaagaatatttgaaacttcaagtcttctacattctttcagcacatggagtttccggggtaaacagaccttgagcagtctctctagctgtggactaaccctcaaaacccacatgtctggaggataggagaggagaagtgggacagactgctgcccctgccagctggagtagtctacgactgagcagctcttcccaagagggctgccacctgggctgtatgctccaagctccgtggtcatccaaccaccatcatcatccaaccacccaacctccctgcaacccaaaggaagtcttcctactcagaattttatagagacaataatagttccttgaaaagaaataaatccacattatggagtgaaatatatttagtaaacaattattacgtctacagcaacacattacacacagtagaggcagaactactgtggggttatgcctactaacaacactgcccttagacccctgcaagtaaaggtcacgtgttttacagaaccatctctggccatcctaaagccacattctcagacacatcttccatcccccatagcaaagagttcaaggggccaaaaggtcttgcccacctggaacccaagccttcccttctaggcaatgatccaggtacccaataccctagaattccctattcatttgagggaatttgattgcaagcctacaaccctgacctatacagccttctacctcacatcctgtcttccaaggacagactgtgccactagtatgcacactcagaggcccaaggagtggccagtggaggggggctgttgatgttgagtatgaatggaacttggacatgtagtaaggggttggaggtgttcacatacatgcagacaacgccccatggttcagggataggaagagaagggagttggactgcaggctgagaatcaggaagccagctgttcttgcacagccatgttctggtgtggaccctgaaagtctgaggatcctaaatttaaacctaatcttccaggtaggtatgaaggtacatttgttaggttaagaggacagatgattttaacaatttagtagcttaattgaaaacttctaaatatttacacatggcagatgaacctccatctgtacccctgtcctggagtccaccagcgttagggaaatgaaagtggccagggagatctctagctctggggggatcctttttttctactatcacctggctctgcaagaccagctgagctgcctcttgattacacctcaacagttttaatgaacacagagaattctcactatgcacatctatagttgctcatcttttttgttttgttttggagacagggtctcactctgtcacccaggctggggtgcagtggtgccatcatagctcactataacctcgaagtcacggcctcaagcagtcctcccacctcagcatccccaaagtgctggaattacaggcatgagccattgtgcttggcctcaagcccatcttcaaaagaacctttatcagatctgtgtccattattctagttatttcacaaacctgtgaaagctctagtaattagggcaggaatattccaaataaatcttatctgtctgttgtgtttatttcatctcctcttttgaatccacagtttttgtgctattcgcaagcaatccaatatttccactcacccaggtctgaactcccataaattgtcctatttttcactttctctacaagtctgttacaagtcccatttcctcattgaagattatttcatccaagtgaaagaaaagcagtcttcagagactaattcacactgagaaatgaatgattgatagtccccttcttactatttcaagtacaattgactatttcaaaaagctctggttaaacaaagtgagtaatttcagctgccagctctagtagacacattttgggaacaagacaggtgtttttacttttatcggtaaagtttttagagcaaaaacttattaacattgataaaatatacttttaattttacaatttacttatatctaaaactaatataacaaaatattccatataataaatatctcagtaaaagaatgtaaactaattaaacttaattggttatgtatcggatcaacggcactagctggaaaagtagaagggaaacttactgtattagtccattctcacactgctctaaggaactgcctgagtaatttataaaggaaagaggtttaattgacttacagttccacatggccggggaggcctcagaaaacttacaatcgtggtggaaggcacctcttcacagagtggcagaagacagaatgagtataaggaaaggcgggggaaaccccttataaaaccattagatctcgtgagaactcactcactatcacgagaacagtatagagaatatcgccctttgattcaattatctctacctggtcccacacttgacacgtggagattattacaattcaaggtgagatttggctggggacccagagccaaaccacatcacttactttctcaatattgaataatgcccaaaggattcgattgatgaactatctcctctacctcccaatttaattctcacaaagcgtgactttagaatttagtaattaaatttgaatcatgactgtctctgctcttcaagcccatgtgaaggtgatttcaactcaagagaattactttaaaatttagagagggcttgttgtcaaacgtgttatgaagaaaaaaaaaaatctccctcaaatgggtttataatacagctactaccatgttcaaagacaaaaatggaacaaggaaggaaattaattttattctcccagttgcattcaggagatcacagatctgaagttgagagcatctcgacagtttatttcacctcagacttgtggggaagagtaaacaagttgtagatgaagtaattttacagtgggaatttctatccatcatacacaggcaacatctagctaatttcagcaggacaaatagtttagctaatctttttgtagacaaagggagatttggaggatccgtgtctggccttgtcatgagtaaacagaggtatcatcctcgagtcttatctaaattacatagggaagagtgattctttatagtcacctgtgtcataatacaaaaagggagggggattttttaactgtcagtttcccaggagcacagggctctggagaagctctccatgatggccccgaggaagaaagtgtgccccgctggcgcacctcctgctgtcccctccacacccctgagagcagtactgtgctcaccatcccctgcttcgacgcccctcatcactgtcactggcctctgtgttctctctctactcatctgccattacaacagacacattcagcccagggcctttgcccacatttgtccctcttcctggagtgttccactccagacatccaagagcaccctccttcagatatttctctcaaatgctgccttttccgtgagactgtccctgctgtattgctaagctccctgctgtgctttatttatctcggtacttcccaccgagaaacacactacgtgcgttacttcttaaccagttcattgggtctcttcccattaggatataacctctgtgaggacagggagttttcaccaccatatccccagcacctggaacacaataggcacgcaaaaaatgtttctaaataaatatgttagaacatttattaatagtatatgcagggccaggcgcggtggctaacgcctgtaatcccagcactttgggaggctgaggtgggcggatcacgaggtcaagagattgagaccatcctggacaacatggtgaaacctcgtctctactaaaaatacaaaaattagctgggtgtggcggggtgtgcctgtaatcccagctactcgagaggctgaggcaggagaactgcttgaacccgggaggcggaggttgcagtgagccgagatcatgccactgcactccagcctggtgacagagcaagatcttgtctcaaaaaaaaaatatatatatatgtatataatatatgtatatatataatatatataatatatgtataatatatctatatataatatatgtataatatatattatatatgtatatataatatatattttatatattatataatatatgtatatataaaatatatattatatatataatatatgtatatatataatatatattatatataatatatgtatatatataatatacatatataatatatgctttgcctcctcacctatgggcaaagttatttattacaatagttaatattctttggggttttacccaaaatagcatgaatagcatgatccgtgaggaatagtatgcctggttattttttgaatgtttagtctaaaaatataaatttttaaacttttattttgtatcaatatgactgaaaatcctaaagctgttatattgctacatatgcttcgaatatcaacttttggaaacttggctttgtaatttacttatctttgatttatctgaaagaaggcagcagaatattgtgtatatcaagaattggctactgactggctcctctgtgaactacgggtcccatgttttaatcatatgccacacatggtcttggtatgtgtctgttaatctctctgcagcaagtgagggatacacagtgtattccgagagttcttttttggtaggaagggataagaggtgggagtgagtgagcacagccacagtttccagaatttgttattatcctgcagaagatttggatttccagaagaggagaaatggggaaaaaaaaaaaaagactaatgaaaaagaaaggagaattaaattctcaagcaacgttcctttatttttactttttattgtaaaactaacatcatcacaagtaatagaattctttaaagtctttgctgagactatgaccctaataaagatttgttttcattattacatatttccctccagttcctgctcacatgcatttataatttttcatttcattgcaatcatagcatggataaaagtttgtatccttaaggtttgttccctgaataattatattctataaacattacccatattaccttagcattttcaaaattatatttttgtgcctgaataatagtccatggagtcacttatgtaccacagagtttacatgttcaggagaggtttccctttttcctgggctatttccctcaacttttctttgcattggacctcttatcagttggactttaaccaaaatcttccaatgtagattaacttggtttaactcaacgttaacttaggttaacttgggttaactcaacgttaacttaggttaacttgggttaactcaacgttaacttaggttaacttgggttaactcaacgttaacttaggttaacttgggttaactcaacgttaacttaggttaacttgggttaacttgggttaactcaatgttaacttaggttagcttgggttaactcaacttaacttggattaactcaatgttacccaaaccacattccacagaccttcccctgagatactaacaggtgctatgtgctatgtgcaggagggatgataagggagaagccctgtcctcaaatgtatttggggagtttttaatgcacacatcttacttatcttttattacttatcctttctgaggtttaatatcctcatctttcccccaaatgagataacatatttagaaggtctaacacatagtaagcactcaataaatattagtttcttcctcttccctttttctgtcctatgttaagtaaatatcaagtatctaaaggagacaactgttgaggttcagtaattactgccagaaaagccaattgagcataaaatgactcgagaaaagggctcagcttcaactaagtagcatgggaaggtggctggtacacccactcaaagtttggctgcttaattatatcatgcctatttacatattgggtacagtgatatcagtgaactataaatttcaaaaagagcttaaatgagtagatggtaagtacaaaatgggaaatggttggggtacctgctaaatctttgaaaactctaaatctagagggaaactgtgtgcttctcctagaagtctcctgaggacattattatagaaaaattagtagaattgacagagcgtctggtgacctaagcacacaagatgaagtgtggaatctgagcttggccctacctgatctaggtcccttggcagctggggttatttctaccgacacctagaaataataaaattttatttgggctcaaatttcacaactgacattcaaaccattgtttcatttatatattccactgatgccttcaatgtaatgtagtgttgaattaagtagtttttccttattcctgataaacttttaaccgtgaccttgataagaagggtgaaagtgggaaatattcagctataagagtatttctctaagtttgatcttcggaccacttacatcagaattattagggatggtgttaaaaattcagattcctaagccccatctcaaacctattgactcagaatttctgggagcaggatttaggaatctgcattttgttttattttattttatttttgagatagagtcttgctctgttgcccaggctggagtgcaacctccacctcccaggttcgagcaattcttctgcctcagcacccctgagtagctgggattacaggcgcacaccaccaggcccgactcatttttatattttttagtagagatggggtttcaccatgttggccaggctagcctcgaactcctgatctcaagtgatctgcccacctcaacctcccaaagtgctgggataaaaacctgagccactgttcccggcccaggaatctgcattttaaatgtgctatgtagatctttcacatgaacactaaagttcagatccttagctggtgttcttgctccattgcgttttttttcaatcgtttttgtaatattctttctcagcttctagatttttcgtgccattctttcaatgagaacctggcatggctcctttcgatcacctcattctgtttagacctatcccttgatggtgaaaggccttccctctgtctttccaatgccatctcactgtctcactagccctgttcccaactcatgagttgtccacttgggtcaacataagatgccctcaaggtgtgctcagcagagctttggagtttccatagaggaccatcagggctactattgtgggagacagggtgggagatggaattgttatgaccctctatttccattcaaccagagctccacttgtgcttccacatgaagtttatctgaagataagactctggtgtatagaacaatcttctaaaaagcatcgtcctagattaaatttactatgccccttccctgtctgcaaagactttgtttcctttgtgtaaaacttctctctctctctctctgtattaatcatggttttaattttctgtatcttaaatatattttgatatcttaaaaatcttgctggccaggaagagactgcctctcccagggctatgaaactcttagagataacaaagggccctgctgggctttgagcacaccttttatatataaaaccaaccaatgtgagtctacacccccaaacctacacctcctaatctaactgtcactgattgagccaatatttctcttgctctaaagcagcccagcagccaggtagcagactagagaccacccctacattccagaactcactgatgttattcaaactagccagtcctaaactgtttactccaccctgccttctgttcactctgccctgccttgtctttccttcaaaaaccctaataagggctctggcttaggctttctccttactatctcctgacaacattggtgttttctcactgtggccaggtgtaatgtgtttgccccttctctcaggaaaggtgagtaatactttcttctttcagtggcattaacccttccatgttacagtcagtcatacctctataaattaagtctcaggtagattgaaaaacatcctctgccgggtgtggtggctcatgcctgtaatcccagcactttgggaggcaaaggtgggtggatcacgaggtcaggagatcgagaccatcctggccaacatggtgaaaccccatctctactaaaaatacaaaaattagccaggtgtggtggcatgcaactgtaatcccagctactcagggggctgaggcaggagaattgcttgaacccaggaggcggaggttgcagtgagccgagtttatgccactgcactctggcctgagtggcagagtgagactctgttgcaaaaaaaaaaaaaagaaagaaagaaagaaaaaagaaaaaaaaaaagcatcctctctcacatttaaggcttccttgtcaacaatcaataattaccaaacttcaaaatgttcctcgaaatgcagctggatcctgcttaacctgatgcagctggatcctgcttaacctgccagcctccagattgtctttaacatcctgagctcaggtaacctcactgcaagttcagcctaaattcttaaattatacttgtctcagttatttatttcatttattcaaccaatatttattgacccaccactatgtaccagaacctgcatttggccccagaaacatagtcttgaacaaaatagacaaaaatccctgccccccaaggaacttatatctttgtgtgcatgacttccccaaatagattgtaaattccacaataggaagttgttctcctacttgttttgcattttcccataggacttattaaagtaattaattacattcattacagaaaacataacataaatttatgacaaagccatttcatgtcttactattaaaactcagagtaaaaggtttttattttctggctatttaaaaaacaattatgaacaacattttctgtaactgcttcctgcccatatctcagattctgtttagaatcaacgacccaaaatttagagagaaagaataaacaacaattatttacaactctttaattctgtaatcaaaaggatgtaattaaatttttctcatactttcttcttaaatatctctacaacccttataagaagagcttgcctaaattcccaaatttacccaacaatttattttacttgcaaaaagtacaaagagctttaaaaggaggaaatgttactttctcagtttccttcttccttttcttgagttcagaacaccttttttttcctacctcactcagtgtactgaacatgaattttacccacatataactcagaaatgacttctgatgtccagcaatgatgggctaacttattcagaccaattctctcactgaaaattactaaaaatactgaataaaatatgttttaatctttatttaaaacatcaatatgccaaaacataagtaaggcattatcaggccaaaaccaagaataaatgagagcacagaaaagtaggccaaccactagaagttgtttctgttccaagggcatctgcctatttggactgtgaaactgagctatggctacaatggattcctggtgtgaggcagatggaaatcatatcccaaggcccaccaaaagtggagaatataacaggacaaccccatattaaactggaacacaaaaggctacaccagaggtaagcccattccctcccttcaggctcagacaactacagaaagagttgttttagctcagcacaaagcagggcataaggaaaagaaaaaggaaatccagccctgagaggctgtaaccacaggaatatttgaagcccagatgtgcagccccaaatttgtactactgccaaaaatctagtttagagtaccagaatgatattatacctaattctctaaaagaagaaaatacaaacctcttccagaggaagttatcttcctattagtaggtctttgagaatcctcagaaatatgttttcaagtgctacgagtaacacagaatcaaagatagccaagcacacaaagaaacaaggcaccatgagcaagaaccagcagacagcagaatcagacatttgcagacttaagatattggaattaccacacacagattattgaataaaaatgtttattatattgaaaggaatttttaaagcttgaagatacaggaaggcacaagaatctataaaaaatgtcaaagcaattcttaaaaagaggcaaatagctctagaaactaaaaacataataatccatatgagaaattttttctataattgaacttagctcctgagtccttatttctgctgataatggaaattacaaatgtattcatgattaaaggtaactcagtcacctccagattaaactctgtctcttttgggtaaatgataacttagtaggcagtaacttagaactaatctaagttccagggtctggcacatccttggagggcagtttggtttgggaggtcttctgttctctgttctgtactaaccctgctttctttcgttcttaggcatttattggcctctttcctcactgcacccactacagaagtgcccacactcccttgataactcctgtcaatctcaactataagacttctttatgtcctctgatttgtatctagtccttgcctgtacttctagaaaacatagaaaattttcactggctgggctaccctctggaggtgcagcatggactgcctcaggtcataaatccccatctaggaagctatattttctcagacagaaagtaggagaaaaattccctctacaatcagatccacaaacttatctgtctgttttttctttcacaatcccactcctctccccaccaagactcaaccaaaataggaaaaaagagctctttttcttctcctctccctctctgtcaagcttcttacccatctcagaaatgagtctgtcccctctctgaatggcaagaaaatattctatgtttactgaagaattctttctgttttatgtttattgtataaactctatgctctgagacctgcaggctttgttttgatattcaaggttttggaacaaaaaacaaacaaagaaataataacctcccccaccccacaaaaaaatttctcttattcagaactttgctgtcagagttgaaagatctcacttggaaaaccctctcttttttgtctattttttatatactgtaagttctgggatacgtgtgcagaacatgcaggtttgttacacaggtatacacgtgccatggtggcttgctgcacccatcaacccatcaattacattaggtatttatcctagtgctatccctccccttgcccctcactctccgacaagccccagtgtgtgatgttccccttcctgtgcccatatgtcctcattgttcaacttccacttatgagtgacaacatttggtgtttgattttctgtttctgtgttagtttgctgagaatgacggtttccagcttcatccatgtccctgcaaaggacacgaactcattcttttttatggctgcatagtattccatggtgtatatgtgccacattttctttattcagtctaacattgataggcttttggattggttccaagtctttgctatcgtgaatagtgctgcagtaaatgtatgtgtgtacgtgtctttatagtagaatgatttataatcctttgggtataatcccagtaatgggattgctgggtcaaatggtatttctagttgcagatccttgaggagtcaccacactgtcaaccacaatggctgaactaacttatactcccaccaacagtgtaaaagtgttcctatttctccacatcctctccagcatcagttgtttcctgacttcttaatgatcgccattctaacaggcgtgaatttgtatctcattgtggttttgatttgcatttctctaatgaccagtgatgatgagctttttttcataggtttgttggccacataaatgtcttcttttgagaagtatctgttcatatcctttgccgactttttgatggagttgtttttttctggtaaatttctttaagttccttgtagattctggatattagccctttgtcagatgggtagattgcaaaaattgtctcccattctgtaggttacctgttcactctgatgatagtttcttttgctgtgcagaagctcttttgtttaattagatcccatttgtcagttttgccttttgttgccattgcttttggtgttttagtcatgaagtctttgcccatgcctatgtcctgaatggtattgtctaggttttcttctagggtttttatggttttaggtctcatgttaaaatctttaatccatcttgagttgatttttgtataaagcgtaaggaaagggtccagttccagttttctgcatatggctagccagttttcccaacatcatttattaaatagggaatcctttcttcattgcttgtatttgtcaggtttgtcaaagatcagatagttgtagatgtgtggtgttatttgtgaggcctctgttctgttccattggtctatatatctgttttggtaccagtactatgctgttttggttactgtaggcttgtagtatagtttgaaggcaggtaacgtcatgcctccagctttgttctttttgcttaggattatcttggctgtatgggctcctttttggttccatatgaaatttaaagtagttttttctaattctgtgaagaaagtcagtggtagcttgctgggaataccactgaatctacaaattactttgggcagtatggccattttcacgatattgatttttcctattcatgaacatggaatgttcttccatttgtttgtgtcctctcttatttccttgaacagtggtttgtagttctctttgaagaggtcttcacatcccttgtaagttgtattcctatgtattttattctctttgtagctagtgtgaatgggagtttgctcatgatttggctctctgtttctctatcattgatgtataggaatgcttgtgatttttgcacattgatttttgtatcctgagactttgctgaagttgcttatcggcttaagaagttttggagctgagatgatagggttttctaaaaatacaatcatgtcatctgcaaacagagataatttgacttcctctcttcctatttgaatacctttatttctctctcttgcctgattgccctggccagaacttccaatgctgtgttgaataggagtggtgagagagggcatccttgtcgtgtgccagttttcaaagagaatgcttccagcttttgcccattcagtatgatattggctgtggatttgtcataaatagctcttattattttgagctatgttccatcaatgcctagtttattgagtgtttttagcatgaaggggtgttgaattttactgaaggccttttctgcatctattgagataatcatgtggtttttgtctttgggtctgtttatatgatggattacgcttattgatttgcatatgtttaaccagccttgcatcctggggatgaagcccacttgatcatggtggataagctttttgatgtgctgctggattcagtttgccagtattttattgaggattttcgcatagatgttcatcagggatattggcctgaaattctttttttgttgtgtttctgccaggttttggtatcaggatgatgctggcctcaaaaaatgagttagggaagagaccctctttttctattgtttggaatagtttcagaagaaatggtaccagctcctttttgtacctctggtagaattcggctgtgaatctgtatggtcctggacttttttggttggtacgctattaattactgcctcaatttcagaacttgttattggtctattcatggattcgaattcttcctggtttagtcttgggagagcttatgtgtccaggaatttattcatttcttctagattttctagtttatttgcatagaggtgtttatagtattctctgatggtagtttgtatttctgtgggatcagtggtgatctcccctttatcattttttattgtgtctatttgattcttctctcttttctcctttattagtctggctagcagtctatctattttgttaatcttttcaaaaaaccaactcctggattcattgattttttgaaggttttttcgtacctctatatccttcagttctgctctgattttagttatttcttgtcttctactaggttttgaatttgtttgcttttgcatctctagttcatttaattgtgatgttagggtgtcaattttagatctctcctgctttctcctgtgggcatttagtgctataaatttccctctaaacactgctttagatgtctcccagagattctggtgtgttgtgtctttgttcttgttggcttcaaagaacttgtttatttctgccttaatttcattatttacccagtagtcattcaggggcaggttgttaagtttccatttagttgtgcagttttgtgtgagtttcttaatcttgagttctagtttgattgcactgtggtctgagagactgttatgatttccattcttttgcatttgctgaggagtgctttacttccaattatgtggtcgattttagaataagtgatatgtggtgctgagaagaatgtatattctgttgatttggggtggagagttctatagatgtctattagttctgcttggtccagagctgagttcaagtcctgaatatccttgtaaattttctgtctcattgatctaatattgacagtggagtgttaaagtctcccacgattattgtgtgggagtctaagtctctttgtaggtctctaagaacttgctttatgaatataggtgctcctgtattatgtgcatttatatttaggatagttagctcttcttgttgcacttatccctttaccattatgtaatgcccttcttggtcttttttgatctttgttggtttaaagtccattttatcagagactaggattgcaacccctgctttttttttttttttttttgctttccatttgcttggtaaatattcctccatccccttattttgagcctatgtgtatctttgcacctgagatgggtctcctgaatacagcacaccaatcggtcttgactcttttttcaattcgccagtctgtgtcttttaattgggccatttagcccatttacatttaagggtaatattgttatgtgtgaatttgatcctgtcattatgattctagctggttattttgcccattagttgctgcagtttcttcatagtgtcaatggtctttacattttggtttgtttttgcagtgactagtaccagtttttccttcacatatttactgcttccttcatgagctcttgtaaggtaggcctggtggtgacaaaatccctcagcatttgcttgtctggaaatgattttatttctccttcatttacgaagcttagtttagcaggatatgaaattctgggttgaaaattcttttctttaagaatgttgaatattggcctccactctcttctggcttgtagggtttctgcagagagatctgctcttagtctgatgggctgccctttgtgggtaacccgacctttcttttttttttttttttttttttttttgagacggagtctcgctctgtcgcccaggccggactgcggactgcagtggcgcaatctcggctcactgcaagctccgcttcccggtaacccgacctttctctctggctgcccttaacattttttccttcatttcatccttggtgaatctgatgattatgtgtcttgaggttgctcttctcgaggagtatctttgtggtgttctctgtatttcctgaatttgaatgttggcctgccttgctaggttggggaagttctcctggataatatcctgcagagtgttttccaacttggttgattctccccgtcactttcaggtacaccaattagacgtagatttggtcttttcaaatagtcccatatttcttggaggctttgtttgtttctttttattcttttttctctaatcttgtcttcacactttatttcattaagttgatcttcaatctctgatatcctttcttctgctcaatcaattcggctattgatatttgtttatgcttcatgaagttcttgtgctgtgtttttcagctccatcaggtcatttatgttcttctctaaactggttattctagttagcaattcctctaaacttttatcaaggttcttagcttccttgcattggaaaaccctcttttaaaactcaaaggtaagagtctgacggttctcactgttctgtttgtatttctctcaggctgatggcagagggagactactaagaaggaaaaatacgtccaataatatttcaaaatattattctgctgtatgagcaactttttatctagttcctacaaaaagaaaacatatttaacaaaaatatttgttggaacgaaatcatcctgggacaaaaaaaaatgtgggacccatagagttttgttatataaggatttcatcagttcataggtttcaagagcaggtcactggcaaactgaattaatttactatgcacttctcacaggtcagaagtagtgttattgcaataattgtagattttgaataaagacatatttaccttgactagtagctataaagatagactgaaacctttttaaatctcaaaattaagagtgctctactgacaccagcaagggtgattatatcaccccgaatatcagtagggaggggctgtttttaatgagaattgatgccataaattgacaattcaaaaatgactcagcattgaaaaatagtacaatatataatattattaagaatagttttagtttcattgatgcagaaactgtttgcacacaaaagaatgcaaattctaagatctctctttcttccaaggataaaatatacgcacacatatatatatatatgcaaagagagtaaatgaaatctgccaactttatatttggaaggaaattcagagacgattttcctgccagcagtcttgggtgtagaccaagtagataaagttatcagaaaggattaattggatcctgatccatatgtaattgagcttccactttggtacactggctattaatgttttagatgggagagtatagtgtctctttcagctagaattgaaatatctataagacgaactggagaaagcattaagaaaacgccaagacacccaggaatttgcatatccctgattgtgactataggtagaggtcacatcagttctataaaatcagcatttactttgtacacctgcctaggaagcaaacaacaatgaaaattctccaatttccaggacttaagtatgtagaaaaattcacctagagctgaaatttacaaaagcaaaactatagagccttcttaatttttaagatttcggttaataagttttagaaattgtttcaaaaagtaaatatccattaagtcatttatagaatggtagagctgagtgtacgtgtgtcgtgaagatcagtgctatggtttccacagcaactacagctctgtctgcttgaatcctcgctttgtactttactcagcctgtgctagtaaatttaggcccatggtgagcacctgtaggcgaatataggtatgcactcacctatctgtgatattctgtgtatttcttataagaactaaggtttccttcttaccatatcatgatctacttaacatttaagcttggaataaacaaagccctatctgggctttcaaatcccatgaggtatactaaaatatttttgtaatagagattgtgggccaggtgcggtggctcatgcctaacactaaccctaaccctaaccctaaccctaaccctaatcacagcactttgggaggccaaggcgggcacatcacctgaggtcaggagttcaagactagcctggccaacatggtgaaaccccgtctctaccaaaaatacaaaaattagctgggcatggtggcgggtgcctgtaatcccagccattcgggaggctgaggcaggagaatcacttcaactgtgagacggaggttacagtgagccgagattgtgctactgctcttcagcctggccgataagagcaaaactctgccaaaaagaaaaaagaaaagacaagaaagaaagaaagaaagaaagaaagaaagaaagaaagaaagaaagaaagaaagaaagaaagaaagaaaggaattatgaccaatgacatatttttaaaaagtaaaggattgcatattggaataatccaaatcccctaaatttacaactgagcaacaactctgtcactgattcaagaaaggtcttctcttgggctcattaattccagaaactgggctaatagaataaggaaatatttcagctcaatttgccttaaaactacatatctggggttcctgaagcagcacttcagtcccttccaactgagcatctcaattaccttatgattctcaataaattggttgattgggctcaacgtatctatcataccaggtcccaatgcttgactgattgctgagtagtgcaattagtaggctgagttatttagaagacttgtccccaccatggaagacaagctccaccccaattactctagagcttcttgctccagtgtttcctatggcaagattttcttctgaatgaaatcatcgtctgtatatttggtgttcatttattaatagatccaacaaatatttatagagtgcctaccatgtgcagggggctgtgctgtcactagagatcctatgctgaccctgtaactaaacaccttgaatggcttctaataaggacccaagcctaatgaacagtgttagagaagattttcaatcaggccattctcagtgaccaaaacccttaatgtggctatcaaatgcccaccgccaggttttcctcttccattacaggctttcatcttacattccaagatcctaccctatgattgacccttcctcctatgtcttccctactctcttcttgcattgctgttagcatgtaaatcgccacttgattcccactgtcactccaatcctgcgttctaccttctgactcctagaaccacttagctgctccatctcatacctggttacttttttctccaccttcatctctcttctcactgaggattttgaagtggtcaagactcagggagaatcaaggcaccatgtggcttttgtctttgaacagttcagggcctaacagggtacaataaatccatttgggacttggatttccaccttggctacatactggttaaaaaaactttgtagtactactgtgaggatctagtcactatttgtcccattgcttctagtggtaaatgtttccaagttccatacagcccatttaccttcttcattttccccctaagccagcctgaattctcagtgaagagaccactatccatataatcacctgaaccagaaacctacagttgatccaattcccttcctgctcactaaccttcctcatccactccttcaccaagccttatgggcttatcttcactgtcactgccttatgtaggttcttatcacttctggcctgacttattgccctaccgcaccccccaccacctcattgagtagtcaaacctatcaacacccatcaccaaacatcacattgctgccgccactggtacccatcaaattcatctctccctatgcaacttatcacatttttttccaaagcatatgtcacttcgtgttctgaatccccttagctttcagaataatgttcaaactccttggtttataacaaatggtttacaatcaggtcctactcacatttgtggcttcctttaccaccaccgtaccatccatccatgcaatccctgtgtcacccatacaggacagtgtgtagctcctgtaacccctgctgctgattcacacctccattatctcacatacactgactgttttctctacttggaatgcccttctttctgtgaatagtgaagttaactcttactgctcttattagtccctcaaactcagtttgccatgtgtcacccactgtgctgagagcagtacatgtattccttgaaccccacctccaacttaggcgcccttcatttgggttccatagctctctagatacctctactagagcacttgccataaataacatatttatttagtcagtttcatttattcattcaacaaatatttattcccatgtgtcctacaatagtgggcaacttagacaagttttctactctctggttcttacaggattgcagggagaaagacaattgagaagtaacaatgatggatcataggtggtaaagtagaagactctgtgggtgtcggggttcttaacacaatccaggaggtcaggaaaggcttcctaagggagccatcctttggttgagcctgaggtatgtaccaggaaaagagatcagcccattaaaggcctagaaatgagagagcacatgcatggggcctctcttcaggtaactgaaataagttcattattaatggagaaaggtagggcactggcaagacagcaagatggagcagtgacagcagtgctggctagtggggagggctgtaaaagccttgtctaaggaagccagatttgtttatccctaaagcaatggaaaggccattgaacgattttaagggtggtgacatggtcagacatgccttttagagtggtcactgtggctgcccattagagatgcagggaggctaattgggacactgttactaatccaagtgagagatgctagtgggctggactagatagtaccagtaggaaagcagaaatgtagacaaactttagagctgcctatgaggtagaattaacaggatttgttgacttattaggaaaaagacatgagggagaagaaagactaaaggataatcccaaatatttagatttaggtagtttggggtgccattcctgtaaaactgggaatttttggatggagagaggagcagttttgacagaaagatgataagctcagtggacacaatagaggcaggtctggaaatttgaaagtcattatcatatagattgtaattaaggccaaggggatggatataatcccattaagctataggtctagtgaggcaaggaccatacattattcacctctgcatctccagggtctgatactgtttctggaacagagtaggtgctttggtaattttattgaatttaatgaatattaattaattaactctgtgaaatgcaatcacatttaatttgaaaatcttccttagtataaaatattggaatacaaaaattgtggtggtactgatatgcatcaacaattgagaagtaacaataacagatcatagatagtttttagaaaagtgatattgaaatggataatctaaaaaaaaaagttgggccgaataataactactttgaagacaaatgaaatgtatttcacttgtacaaattaaagcatagttacagtccaaaaattaccaaagcagattgcaagtgctattttatcatcatttgtacagtgtgatggagcaattaaaatttgatatatgtatttgtctatgcataataattagcaagagacaaagagattaaaaggatagttaaagaaaaaccaaaaatgagcatcctttcagccatgcatttggcaccacacacatctgctttcagcaacagcctgtcatggtggcttgcttttgattttccactggttcccctcacagaacttatatgtggggaggcaacaaaactcttcttgtgtattatcatggtaattttataattatattcaaaggaaattctttgaatctttttattcttttattggaaataacatttaaatgtgggaatacattccctgagaccaaacagtgtctgccagcaatggtaataaatatcagtcctactcttcaaagaaaggatatgttccccagtatttttcaagcatgtcttttttcccctcttgaataaatttttgttgattctttcatttcatcaaaatatctagaaagtacaggtaccactcagaaattttacttttgaattttggcatgtagtccatcatttgtgcaaggccaaaagataaatttcaagtgagtcattactacgagtgcattgtggcagaaaacatcctggccaaaggcagacatgggttcgcattgcaatgcacttgcttgataggtacagaagatccctcaacctctctaggtcttatttgtctcaactgtaaaatgaggaattgaacttacttagttctttatttttttttatttttttattttttcttgaggcagggtcttgctcagtcacccaggctggagtgcagtggcatggtctcggctcactgcaacctccacctcctgggttcaagcaattctcgtgcttcagtctcccgagtagctgggattacaggctacaggcgtgcaccaccatgcctggctaatttttgtgtttttggtagagacggggttgctccatgttggccaggctggtctcaaacttctggcctcaagtgatctgcctgcgtcggcctcccaaaatgctgggattacaggtgtgagccaccgcactggtctgggtttagttacttctaagaccacttctagctctacgatcttattctatcctcaaaaacattttattacttcgtgtagacttcattaaatttgactttgctttatcattttatgttctctattaattaccaagattttatatactatgtctctgtgcccagtggaagctaaagatctaggaacatagcatgagtatgggaatatgctaacactcataataatgtttctattctttgggcatttaccacatgtcagtcattgacttaggcatttgctctatcacatttaatcttcatgacaaccttatataataaatattaatatccccattttacaaactatgaaattgggacttgtatatgttagtaacttgacagaaagtgctattggtgaatttcaaccctagatctaccagctcctgagcctgtgcttttaaccattatgttacagctggatttctggctgggtctctctccgagggttggagtgaacccagtagaagcaggtaacacccaggaaggagtgttgagtgaagtcatctgggatgtttacccacaaaatgcagacttgagaggtgagcaaggaagggagaaccaagattatgctggagggctgtgcaaactgtggttgtaaggctgtgggaagtatcacatccacacagggtgaggcaaggatggatatgggaagatgagcagtgacattggtagcctggagaatcttagcttcttagtactggatcttagcagaattctctccaagtcttcatcactaagatgaggtatgacaggattatgtgaaaattctccttcaaacactacctagtgatggcataagaaaatagagtgagaatatctttaagatactcttgaagaaacaggtggcaagcagtttgtgctagagcttctcccagtgactcatgaaaggcacaatagaaaggatttccaagttaggcaaagaaggaaaggagagctggagaaggtatactaggaagagatctcatgtgcctgaaaattataactagaaagatacaatgggtgcaattggtgctaatgttctataatgccaggccatctcatttcacagggtgcagacctcagagataaccatacccaccatttagaaacttttctaccttaataaaatgggatgttgtcacatcagaagtacatgaattgctttcaccagacacaattggctcttataaagtcttcttgcttaaaagattgactctaaacttaatctaacctccacataatgatcggtttgcagtatacacaggaaatagagaaacaagctaagtgacatgcaaattaagtactcaggcaaatcctacattctataggacaagtgatgcagtttctccaaaaataaattacccagtttctccagcaaattaatggcatgaaataaggggagatagattatagaataaaatacacttaataaatgttaatgtaaaaatcaatagttggtgtaataatacaacttctagtaatttctcctaagtaaacaattagagaagagagtacagatgtatgtaggtaagtgttcactgctttattgtttgtaatggtagaaaaagatgcagtttgggctgggcatggtggctcgtgcctgtaatcccagcactttgggaggccgaggctggtgggtcacctaaggtcaggagttcgagaccagcctgaccaatatggtgaaaccccatctctactaaaaatatgaaaattagctaggcgtggtggcatgtgccttagctactcaggcggctaatacaggagaattgcttgaacccaggaggcagaggttgcagtgagccaagatcgtgccactgtactccagcctggggtgacagagtgagaatccaactcaaaaaaaaaaaaaagagagatgcagttctgagacagaaaaataaattaaggttgggggaaaggaaagcaagttacaggcagtaggtatgtatgtcatgtcatggcatggtgtgatgtggtgtggtatggtaatcagaaaacctagattttaacatgcttgggcaaattaacctctatgagactcagtttcctcaacttaaaatgaggatgattaaagttcctatctgatagggatgttatgcgattaaatacaataatattaagcacaaggcctggcagagtaaacattcaatatatccttccagaatatacaccagactttcgagaatgatcatctctatctacagaaggaactatggtaaacttttttaccctttctgttttaaattgcctttcattgtcattcaactctaacatttttgtcattttcattatgagtgtatgtgcatccttttttatggttaataaactttattttttagagcagttttgtgttcatagcaaaactgagcacaaagtacagagttcctatatacccctgccccctacacgcacaaccttccctactatcaacagtatatcctttttaaaccatgagtttttaggtgtgattttaaattttcaaagaaataggtacttttaactgctaatttgatatttaattgcatagtcatcaaagaaaatggtttggatgatcttgattctttaataacttatatttaaacatttattttcctttataacctaatacatggtaaatacttgaaaagaaagcatattttctgtatactggttctatatattttctatatgatctgttgttttttatatatacttttaaatattggatcacaatcatgtatttgtccattttccttgtaatttgtcttataattttcttagattttcaaggctatgtagtggccttcttaatcctcagtgacctttttttttctttgctttatattctattttctcatgcaaatagtttacatgagaaaaaggcaccatgagggaaagagtaataggagacattgggcagacttcaagcaatatgagtcagaatagtgtagtggttactagcatgttctttgaatgaagactgatctacattgaagtccaagctccaaagcttggtctcaatttactcatctgtaaaatgtagatgatgatcattgtacctaccccaatacaaatctacacttttgaggtaccctggggtataggttggggcattgcagaatcctgacaaatttcctgaaagttctaactgggaaataaatccattttgacattgaataatacatgagcttgagagagtttacttacttgtggtaatgaaagggaattatttttaaaacttttctagctaaaataaaatctccagttggcatagtgtaattggtcattgttcctgaatcactgcttcatcaccccagtttccagaggcactaaatgagatggagataaagaagaaattccccaaattcttcatttcattacatgttccaaaggcagaaggaaatctctcctcagttatcattttgtgagtaaattttgactaaaccaaagtaatctattaagtcactcataatattcctaataccccaagaaactattaatcgcaaaattataacagaaatttactcaatgcctgttcctttcactttcctatgtaaattaagaccctctggccatctctttttccatgacagttcataaagccaagcctaatcttctcctgacaatacatctaaagaagtgagcttcaaagtctaagcgaagagcaagaagctgagatgaattctgtaaagaaaaaatgcgctctgaaaataacttgtccagattcctcctagcaggttaatttaggatctgatactagtttctcattgaaattttcagaaaatgagtgaagcatttgaaacagaaagtgcaattgtactcatgcacttaattttccaaggttcaactataccaactttattatacaaggtttgtacatttcaaaactttaaaatatttttccagttcaatgaaagggctattttcaagaccaagaaatagcaaaattttgtgatgaccttttgaaacaagtagacctatcagttaaaaggtcaatgatatccttttacttgcatttccatttataaaattggcaattcttccttaaacaattgtcagtataattgacatagtacatacatttattctttatctactagtcatcctctgagtgctgaggtgtaaaggaggaggctgttatttgggatcttgagctgaattcatagcattgatcttaattcagccgagtgattagaacccagtgtggtacctttctgtttagactgaagcaggtaagaagggtcagtcacaaggaatcaaatgattcaagaacttcatttgcagtaccaaggagcatcccagcgcacttatagattgaataaataaaaactccatcaaccatttacattgaagaaaattgtttttccaaactgtcttccataaatgttcacttttcaaaagcatttcatcttattaacctaagaacacgtggtagaggaaaagttgaagtcatgcttgacagtaagtgatatctaccaatgcctggtatggatttttcccaggatttgtagctgatataccatagagatatgggtaaattgtgtcacaaaaaaactgcagaattgaactagaggtcccacagcaggacataccataatattttagggaaaaaaaatagattcccaagcaatctcacttctagaaccaacccctgacacttctctgctttctagtgcgctgaagcatttctgaggcaccagtgtctcagcatgatacagttcattcataccagcaagcatgtggatggcttccacttaggctgtcaaatttttattcttgttaagaaacaaggaatacagggattcagagaacttaaattctttcttacatggtgaactatatttggacaaaagtcattctggttggtctacaggttgtcattctccaaacttactcttcattctcttgcctctgtgttttgcaagttctgaagcctctatctcatatttcctcacttggtaaactccctctcatccccacaattaaagccaaaggctcacatcctctgagaagttcttcttgactcaaggccttccttgtctgcatcaaataaccttaaagactctttaaagtaattattgtcttatttatctattttgtccactacagttgagtacaggtgccatgtctttcctacgttgagtgccagaggctaagctggggctcagaaaacatgttgaatgaacacatgaatatatccatactaaaattgcactaggccaggcacagtggctcacacctgtaatcctagcactttgggaggccaaggcggatggattgcctgagctcaggagttcaaggtcagcctgggaaacacagtgaaactctgtctctactaaaatgcaaaaacttagctgggcatggtggcatgcacctatagtcccagctactcgggaggctgagtcaggagaatcacctgaacctgggaggcggaggttgtagtgagccaagatggtgccattgcgctccagcaattttttctaaaaaaaaaaaaaaaaaaaaaaaaaaattgcactagaagtttagtccattagaacaaagactatcttgttcattatcagagtatatagattctgataattcccaggcacatgctctttaaataaggaaagtagaaaagcaaacatcctggcatctagcagtcacttaataaatggttcttgaataaatgagcatttttaatgaaagactatatatcatattaggcaattccactgaaaattaaaatgggaatttcctttaaacaaaataatctcttcaacaccaagaaaacctccattcaaaagtgttcagattatgttattgaggccaaaagaattcacggcaccaatagagatatagcttagcagcaacacaattgtaataatacaatattttctttctttctttctttttctttcttgcttcttttttattccttccttccttttttctttctttctttctttctttctttctttctttctttctttatttctttctttctttctttctttctttctttcctttctttctttctttttttacttttttcttttgtttttttagagggagtctccctcttgttgcccaggctggactgcaatggcacaatcttggctcactgcaacttccacatcccgtgttcaagcgattctcctgcctcagcctcctgagtagctgagattacaggcatgtgccaccacgcccggctaatttttgtatttttagcagagacagggtttcaccatgttggccaggctggtcttgaactcctgacttcaggggatccacctgcctcagcctcccaaagtgctgggattacaggcgtgaaccacggtgcccggacaacaatacaatattttcaaaaattaattttgggtttttcttttccagcttccttctatgtgaccacattgtcttcaggaaagtaggatggttaaattgagaataaaagagaataaatggtacatgtttggctctgtgactctgaagcatgcttttgagaaccaaagcaccatcttgagggtccccagagatcataacatagaaatagaaagagattagatgaagggccaggacctcagcttcccctcaaggagaagtgacagatatagagagagaacagcacttggagtcagggataggggagaggagaacctgacctggagtcactccactaagaggtttggtggaggtgaagatggtcaacatcagaagaccatgcagaattgttggagttcagtagcaggatggatgtgagaatgccgctctaaggatatgacttttgtttgtttgtttgtttgttttgagatggagtctcgctctgtcgcccaggctggagtgcagtggcgcgatctcggctcactgcaagctccgcctcccgggttcaagcaattctcctgcctcagcctcccaagtagctgggactacaggcatgcgccaccacatccagctaatttttgtatttttagtagagacagggtttcaccatcttggccaggctggtctcggagtcctgacctcatgatccacccgcctcggcctcccaaagtgctgggattacaggtgtgagccaccgcaccaggccttaggatatgactcttgatcagggatccaaaggatgtgtaggagctatgtaggagctttcatgggaagctgagataactaattatagcttgaaagagcactacacatagcatgggtggaggggctattttgctattccttctatcaataggtgttctcatgccatctgtggtttttttcagcctaagaacattcacctgtatctcaagacttttttttaactccacctatactgccccatatgaatatcccccatttctcaattgtccaggatacccttaagcctcttgccagttctttaaatagggtgaatgagaatttttggcttccagtgtgtcaagaggaacagagtggtgtggaagagagaggcacagcacaggtacttaggaaacactgggcagcgatcaaactacctccattatatgtattttaaatggaagttgaagttgtctgcaaactctgtataaattagcagtgagattaaattagcagaatatcacttcagaatctaataaatctggtcagaccatatctaatgttgagatcttttccctgaataccaaacatgaggggcacacattcaggagaatacagacaggatgatcacaggagagtagtctaaagcaatgggcacacacagtctaaagaagaaaaaacttgggtgaagtctttcatgagttgtagggtaagggagaacactggagctcgttactatactcccctgaatagtggctgccactagtggtcagacctattcaaaaatggagtgttcaagatcagttagttgaccagttggttaaaatggtgctaaaggacctctaaagggtgagtgggatggggtgacttctgactcaaggcatctttaattctatgaaataaagacaaaggattcattttatcagttaacaaacatttattcagcactcgttatgtgtcagacactcgttatgtgtccagcactcttaagtgctggagatgtaatggaacaaaatgagacatggcctctctcatgcagctcacagtctagaggagagaaggtagacaaaataatcacacaagcaaataaaatttcaatggtggcaagtgttacaaaggaggaatgcacagtgctatgataacttttatttggggtatacctgggcaggaatgtgaggatggctctttaagtatatgactctttatcagagatccaaaggatgtgtgggagctacctaggagaaaagggaagagcggtcaagatcattgaataaaatacgcctcatcaaaaagcaatatggtataatcattaaaagatagagctgaattccataccttccacatatgagttgtgtgtccttaggtaagttatttaagctctcagcacttaagagttcttatccgcaaaattagaaaaatatatatttcacagggttaagataaatgaaataaggggtgcaaaatgattagcccaagccaatgtgtagtgtttattaaactttagtgataatccataaatggacatgaaatgacaatgacaagttatttattgaaggtagaacaagaacattttaaactacaaaacagtccattcttggatcctgaaaatctcagcattaaggctgggattataaaatcattaatagtaggtagtgtgaaccatggtccacaaatctgttatgaacgagatcccataatttttcatttttctttgaacctaattaaatattactcttgcctagatcagggaaattttcccgtagatcaaagaattgttctagatcaaggaatgcaatcttaatgattattggattcctttgtcccccctaattttcagttcatcaaagtggtgcctgataaattcactttccaaggtagcttcacccctttacagcaggcaactcacctgaccaaggtttctgtcccttttctcatctgaagcactctcttctctctggtatttctcctcctcttcctcctttttcttatctttctccctcccacttctttctcgccttctattcttcctccctctcttcaaaatatctctgtctctccctatattccagaacacaaagccagtgtctttgatgacctaggctagaacagtgcctgacacaaagtgggcctgagtcttcccaaaactcctgagtcaggaaacacaaaaaggctgggtccattctggcaaaggggagaggggaaagcacagagaagaaagcacaagacaagagttcaacacaaaacctacacactcactccaaatgtaggcaattgtgatgagacaaatgggtcctacattcaagatgagtctccagaaatgacttgttggatcctttcctccaaggccaaggaagagagatggtaagataaaaggctaagttggaggtcccccaggagaagcctaaattgcttagatttagcatttgaagtgaggacagaggtcaagaagataaaatgaagagggatggacagaagaaaagagagaggatgaattttttttaagttgcataggtgaattgaaataggcacgaatgaaagtttctctctcttaaaagctttaaaccaggggcagatgtttttaaaccaatccttagaatcactccatcaatgaggacttgacaggcaccaatggtccactcaaagaatttggttgagaaaggttttatgaaaccttcacacatttacagaggtatgggcagggttaaggaaaccaatgtgagatggtgacgtacgcaggaactagcaagcatggagagctgtcacccttaggcctaaaaggcaatgaaccaagtgacctgagtctaaagagaacctcaagccatggaagtaggaccacctaactggagctgcaatcttccaacacagctaatgtagccagtgccctaatcatgacaaggaattggagtggggaggtgcacagggggatgaatactcttacatctctcttctcccactccctccattttctgcgagttccttcaacagctgaacccaattggaagccagagaacagggagcctgggtcatgtgatcctcaaaggtcagccttctcaggcatagagtaggttaaagaagagcaaataatggatcaacatgggggaagggtgctggtaagtgtagtgtacttactggtgatgaacatttatgccagccaaagagattggctcattcttgaaacttaaaaagtatacaaatgaagaaaatattagtggtttccagggattgaagagggggtggggttggtggggaagggaatatggctataagagtaacatgagggattcttgtgaggatgaaaatattctgtatcttgactgtatctctataaatatcttagctgtgatattgttctagttttgtaagatatttccttatgggaaactgggtaaaagttatacaaaagctcttgtattattcttacaatagcatgtgaattataattatttcaaaataaaatatttaataaaaaaaggaaaaaaaggttagcttaggatcagatgttggatatttctcagtcttatgtcatcaaaagaagtataattatttgcttcccaaaaaaactgagtcttccatttgatttacacagaaatctgtagctcctgtgattcttagcaataatcactgaacgaattgatttctgctgaaagtttctcactctttgacttgaccatatctttagaatatttgttagactgcaaaatcccaaacacacccatgaatagccttggtctgttaagacactggaggaaatgcatgattgagcacagggaagcagagggaactaaggaacagatgtctattagaaataatcaaaggaatagagcaggggaagtgaaggcagtttattaaaatattcattctccatcttgttacaagaagatttaataggggtattaaacatagtacaataaaaattgcacaccttgtagaatggctattatcaaaaagatgagacataagtattggcaaagatgtggagaaaagggaacccttgcacactattggtgggaatgtaaattagtagtacagtcattttggaaaataatatggagattcctccaaaaactaaaaatagtattaccatatgatccagcaatctcacttctgggtatacatccaaaagaatgaaatctgtacgttgaagagatgttcgcacttccatattcactgcagttctattcacaacagccaagatatagaaccaacctaagtgaccatccacagatgaattgctttttttttaatacgctagatatacctaatgaaataacatgcagccttaaaaaagaacaaaattttgtcatttgaaacaacatagtggaatccagggaacattctgctaagtgaaataagccaggcacagaaaaaactgcatgatctctctggtaccagaggctggttggggaggggaaggcagcaggcagagcgaggggaaatgttagtcaaagggtacaaagtttcagttagatggagggacaagttctgatgatctattgcacaaggtaactatagttaaaataatgtaatgtatatttcaaaattcctaaaagtggattttaaatgtgcttaccccaaagaaatgataagtatgtgaggggacagacatgttaatgagtctaatttgtttattccacaaggtatacatgtactaagacatcatattttgccccataaatatgtaattatttgtcaataagaaacaaaaattaaatttaaagaaatcaactcaaaatgggttaaagtcttaaatgtaagatctgaaactataaaactaaaagaaaaaagcacaatggaattttttttaaaatatgaataaatctgctaaagagaaaaacaggatagtaaccatgagacccagtcaggagtagggctagtacacaacataaaagcctaaataaagccatgtacagtgtgagaagtcagcccttcaggtagcctctggccctacctttctaacagccaatgcaaaaagcaagcgtgacctattacgtgattataagataaaacttgacttgaaagaaatctctttgttgtgtccctatagaggtgacattacagtttcctcaacaacacccttaggattaataacactagtttcattgttcagtaaaaacagttctaactgggacctaaataatgcagtttaggtgtccagttttctgacttttattaggggacatttcggagtatgttcaaaatgaaagaataatattctttaagaaatttaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaagaaatttaaaaaaaaaatgttttccaccaagcttcgggtaggtattagtaaggattcaaactcaaatgcctaccgagtgcaagaaggtaaaacaatgaagagaaatggatgtctgttaaaaacaaacactaaaaaatacaatgataaaatagcatttgacaaatggtctccatttgggggttacaataaggtgtggtagggactatgtaacctagagcctattgctcataaccagcctattgttatcagaactgaaatagggccagatgttgctaggtctcttatttttcctgtgtattagagttctattacagaaaacagaaaccactctagctattttaagcataaagggcaaagggcttcaacacagggaattaggtgcttactatgtgttgaggccaggcctccaggacttgctgacagggaacaatgaagaatcggctctgaaggaagctgccaactctgcctgagtcagaggaccggaaatcagtaagcttccccctgaaccgtttgctctgggaacgacctagggattaggaagatattgctgctgctgctgctgctgctgctgctggttccagagccatgcttcacccatccagggtcacactaacaacaaaaataacaacagcttaaagatgctgctgacaccacacaccttttgacccttacaaagctggtggcaggaacgctgctacaaaaaaccccaaggcaggcttgatctgatcatgcctaccaccagcagcagccaggactgctgccttttaaatctcacttgaatgcatctcgttggtcaaagttaaagctaaatcacatctgactgcccagcttagaaatgtccctttcagctatccagcctctgggggtggggagtgacaatatgtagaatgtatgcaaagtaaaaatccattttattcaccatattgtatttttacgcaaagatcatctgagctttttaatgctggcaattaattcaatttttaaaaaattaatggatgggcaggccaataaagttgatgtcaagaaaatgcatctgtgatccagtctggtggctcatgcctgtaatcccaacagtttgggaggctgaggcaggaggatcacttgagcccaggagttcaagaccagcctgaacaacatagagagaccctgtcactacaaaaaaaaaaattaattagcaggtcatggtggcacatctgtggtcccagctatttgggaggctgaggcaggaggaccacttgagcccaggagctgaaggctgcagtgaactatgatcatgccaccactttctagcctgagtgatggaaaaaggaaaggaaaggaagggaagggaagagaagggaagggaagggaaagaaagggaaaggaaaggaagagagagaggaagaaaggaaggaagaaagagagagaaagaaaaagaaagaaagaagagagaaagaaagaaagaaagaaagagagagagaaagagagagagaaagaaaggcaggccaggcacggtggctcatgcctgtaatcccactttgggaggccaaggtgggcagatcacctgaggtcaggagtttgagaccagcctcaacatggcaaaaccccatctctactaaaaatacaaaattagacaggcgtggtggtgcatgcctgtaatcccagctattagggaggctgaggcaggagaattgcttgaacctgtgaggcagaggttgtggtgagccaagatcgagccattgcactccagcctgggcaacaagagtgaaactccatcaaaaaaaaaaaagaagaaagagaaagaaaaaggaaagaaagagaaagaaagaaagagagagagagagagagaaagaaaggaagaaagaaagaaagaaagaaagaaagaaagaaagaaagaaagaaagaaagaaaaaagaaaagaaagaaagaaaaaggaaatgcatctttgaacagattcagcttcagaacaagtaacaggagggtagactttggttcacttcagtgcatggaggaagatatgaagccccaacccctcactccagttcatatatgaataacagtgtctatagtgtgctatattcaaagcacttacaaaggtatttattattacaaaggtagtaaattattgataaaatatttcaacaatacataaatgcatatagtaaaatttagtttatcttcttttactacccaatgccactccccacatgtaataaccaggaataacatgaaataagtcagacttctctgtgttggaagttgaatctgctagaagcatcctttgattcagggggtctatacagagaaagctagagccaagattttggactaataagagaacctagccaatacatatggtgggggtttaatttggctggtgagtttagtgactgaggaataggtggcctctccaaaatggatagctcatattcagctgggaacaaagggaatttcttataacatattttacagcaaagcaaacaaatacaatgttctgtatcgaggtgttttacaagcttcgtggtaatctcagactttgtggttaatggtcacatttattgttaatatttaaataactgggcaggcacagtggctcatgcctgtaatcccaacactttgggaggccaaggtgggtggatcacttgaggtcaggagtttgaggccagcatggccaacatagcaaaaccctgtctctattaaaaatacaaaaattagccaagcgtggtgggaggcacctgtagccccagctacttgggaggctgagggggaagaataacttgatgccaggaggcagggttgcagtgagctgagattgcaccattgcactccagcctgggtgacagagcgagatcctgtctcaaaaaataaaaaataataaaaaggaaggaggttccaagatggccgaataggaacagctccagtctacaactcccagcatgagccacgcagaagatgggtgatttctgcatttccaactgaggtaccgggttcactggggcttgtcggacagtgggtgcaggacagtgggtgcagcccacggaccgtaagccgaagcagggcaaggcatttcctcacccgggaagtgcagcgcaagaagtcggggaattccctttcgtagctaagggaagccatgacagacaacacctggaaaatcaggtcactcccaccctaatactgcacttttccaatggtcttagcaaacggcacaccaggagattatatcccgtgcctggctcggagggtcctacgcccacggagccttgctcactgctagcacagcagtctgagaccaaactgcaaggcggcagcaaggctggggaaggggtgcccgccattgctgaggcttgagtaggtaaacaaagcagctgggaagctcgaactgggtggagcccacctcagctcaaggaggcccacctgcctctgtagactccacctctgggagcagggcatagctgaacaaaaggaggcaaaacttctgcagacttaaacgtccctgtctgacagctttgaagagagtagtggttctcccatcatgcagtttgaaatctgagaacggactgactgcctcctcaagtgggcccctaacccccgagtagcctaactgggaggcatctcccagtaggggatgactgacacctcatagggctgggtgcccctctgagaggaagcttccaaaggaatgatcaggcagcaacatttgccattctgcaatagttgtggctctgcagcctctgctggtaatacccaggcaaacagggtctggagtggacctccagcaaactccaacagacctgcagctgaaggttctgactgttagaaggaaaactaacaaacagaaaggacatccacaccaaaaccccatctatacatcaccatcatcaaagaccaaaggtagataaaaccacaaagatggggagaaaccagagcagaaaagctgaaacttctaaaaatcggagcgcctctaatcctccaaaggaatgcagctcctcagcagcaacagaacaaagctggacggagaatgactttgacgagttgagagaagaaggcttcagaagatcagtaataacaaacctctctgagctaaaggaggatatttgaacccatcgcaaagaagctaaaaaccttgaaaaaagattggacaaatggctaactagaataaacagcgtagagaagaccttaaatgacctgatggagctgaaaaccatggcacgagaactacgtgatgcatgcacaagcttcagtagccaatttgatcaactggaagaaagggtatcagtgattgaagatcaaataaatgaaatgaagtgagaagagaagttcagagaaaaagagtaaaaagaaatgaactaagcctccaagaaatatgggactatgtgaaaagaccaaatctacatctgattggtatacctgaaagtgatggggagaatggaaccaagttggaaaacactctgcaggatattatccaggagaacttcctcacctagcaaggcaggccaacattcaaattcaggaaatagagagaatgccacaaagatactcctcaagaagaacaactccaagacacataattgtcagattcaccaaagttgaaatgaaggaaaaaatgttaagggcagccagagagaaaggtcaggttacccacaaagggaagcccatcagactaacagaggatctctcagcagaaactctacaagccagaagagagtgagggccaatattcaacattcttaaagaaaagaattttcaacccagaatttcatatccagccaaactaagcttcatacgtgaaggagaaataaaatcctttacagacaagcaaatgctgacagattttgacaccatcaggtctgccttacaagagctcctgaaggaagcactaaacatggaaaggaacaactggtatcagccactgcaaaaatatgccaaattgtaaagaccattgatgctagcaagacactgcatcaactaatgagcaaaataaccagctaacatcataatgacaggatcaaattcacacataacaatattagccttaaatgtaaatgggctaaatgctccaattaaaagacacagactggcaaattggataaagagtcaagatccatcagtgtgctgtattcaggagacccctctcatgtgcagagacacacataggctcaaaataaagggatgaaggaagatctaccaagcaaatgtaaaacaaagaaagcaaggagtctctgataaaacagactttaaaccaacaaagatcagaagaggaaaagaaggccattacataatggtaaagggatcaattcaacaagaagcgctaactatcctaagtatatatgcacccaatacaggagcacccagattcgtaaagcaagaccttagagacctacgaagagacttagactcccacacaataataacgggagactttaacaccccactgtcaacattagacagatcaacgagacagaaagttaaaaaggatatccaggaattgaactcagctgtgcaccaagtggacctaatacacatctacagaactctcctccccaaatcaacagaatatacattttctcagcaccacactgcacttattccaatattgaccacattgtaggaagtaaagcactcctgagcaaattaaaagaacagaaattataacaaactgtctctcagaccacagtgcaatcaaactagaactcaggattaagaaactcactcaaaaccactcatggaaactgaacaacctgctcctgaatgactactgggtacataacaaaatgaaggcagaaataaagatgttctttgaaaccaatgataacaaagacacaacataccagaatctctgggacacatttaaagcagtgtgtagagggaaatttatagcactaaatgcccacaagagaaagcaggaaagatctaaaattgacaccctaacatcacaattaaaagaactggagaagcaagagcaaacacattcaaaagctagcagaaggcaagaaataactaagatcaaagcagaactgaaggagatagagacaaaaacccttcaaaaaaatcaatgaatccaggagctggttttttgaaaagatcaacaaaattgacagaccactagcaggactaataaagaagaaaagagagaagaatcaaataggcacaataaaaaatgataaaggggatatcaccaccaatcccacagaaatacaaactaccatcagagaatactataaacacctctacacaagtaaactagaaaatccagaagaaatgggtaaattcctgaacacatacaccatcccaagactaaaataggaagaagttgaatccctgaatagaccaataacaggctctgaaattgaggcaataattaagagcctaccaaccaaaaaaagtccaggaccagatggattcacagccaaattcttccagaggtacaaagaggagctggtaccattccttctgaaactattccaatcaatagaaaaagagggagtcctccctaactcattttatgaggccagcatcatcctgataccaaagcctggcagagacacaacaaaaaaagagaattttagaccaatatccctgatgaacactgatgcaaaaatcctcaataaaatactggcgaaccaaatccagcagcacattcaaaagcttatacaccgtgattaagtgggcttcatccctgggatgcaaggctggttcaagatacacaaataaataaatgtaatccattatataaacagaaccaaagacaaaaaccacatgattatctcaatagatgcagaaaaggccttcgacaaaatttcaacagcctttcatgcgaaaaactctcaataaattaggtattgatgggatgtatctcaaaatattaagagctatttatgacaaatccacagccaatatcatactgaatgggtaaaaactggaagcattccctttgaaaactggcacaagacagggatgccctctctcaccactcctattcaacatagtgttggaattcctggccagggaaatcaggcagaagaaagaaataaagggtattcagttaggaaaagaggaagtcaaattgtccctgtttgcagatgacatgattgtatatttagaaaaccccatcgtctcatcccaaaatctccttaagctgataagcaacttcagcaaagtctcaggatagaaaatcaatgtgcaaaaatcacaagcattcttatacaccaataacagacaaacagagagccaaatcatgagtgaactcccattcacaattgcttcaaagtgaataaaatacctaggaatccaacttacaagagatgtgaaggacctcttcaaggagaattacaaaccactgctcaacgaaataaaagaggacacaaacaaatggaagaacattccatgctcatagataggaagaatcaatattgtgaaaatggccacacttcccaagataatttacagattcaatgccatccccatcaagctaccaatgaatttcttcgcagaattggaaaaaactactttaaagttcatatggaaccaaaaaagagcccacattgccaagacaatcctaagcaaaaagaacaaggctggaggcatcacgctacctgacttcaaactatactacaagcctacagtaaccaaaacagcatggtactggtaccaaaacagagatatagaccaatggaacagaacagcgccctcagaaatgataccacacatctacaaccatcccatctttgacaaacctgacaaaaacaagaaatggggaaaggattccctatttaataaatggtgctgggaaaactggctagccatatgtagaaagctgaaacccgatcccttccttatacctcatacaaaaattaattcaagatggattaaagacttaaatgtcagacctaaaatcataaaaaccctagaagaaaacctaggcaataccattcaggacataggcatgggcaaggacttcatatctaaaacaccaaaagcaatggcaacagtagccaaaattgacaaatgggatctaattaaactaaagagcttctccacagcaaaagaaactaccatcagagtgaacaggcaacctacagaatgggagaaaatttttgcagtctacccatctgacaaagggctaatatccagaatctacaaagaacttaaacaaatttacaagaaaaaaatcaaacaaccccatccaaaagtgggtgaaggatatgaacagacatttctcaaaagaagacatttatgcagccaacagacacatgaaaaaatgctcatcatcactggccatcagagaaatgcaaaccaaaactacaatgagatagcatctcacaccagttagaatggtgatcattaaaaagttaggaaacaataggtgctggagaagatgtggagaaataggaacattttacactgttggtggaactgtaaactagttcaaccattgtggaagacagtgtgagattcctcaaggatctagaactagaaataccatttgatccagccatcccattactgggtatacacccaaagaattataaatcatgctgctctaaagacacatgcacacgtatgtttattgcggcacttcacaatagcaaagacttggaaccaacccaaatgtccatcaatgatagactggattaagaaaatgtggcacatatacaccatggaatactatgcagccataaaaagtgagttcatgtcctttgtagggacattgacgaagctggaaaccatcattctgagcaaactatctcaaggacagaaaaccaaacaccgcatgttctcactcataggtgggaattgaacaatgagaactcttggacacagggtggggaacatcacacaccggggcctatcgtggggtggggggaggggggaggggggaggaatagcattaggagaaacacctaatgtaaatgacaagttaacgggtgcagcacaccaacatggcacatgtatacatatgtaacaaacctgcacattgtgcacatgcaccctagaacttaaagtataaaaaaaaattaaaaataaataaataagtaaaaattgaataacttagagaacatcttgcccttctcagtaaatattagaaggagctataatttattatattctaaacactatagcaaaaaatttaaatttaaataagaccttcgttcccctagcttatctttcagcaatgtttcttgtttattttgctcttgttttctttttttttcttttttctctttttgaggcagagtgttactctgccacccaggctggagtgcagtggcaccatctcggctcactgcaacctctgcctcccgagttcaagcaatcctcccgcctcagcctcccaagtagctaggattacaggcacctgccagccagcccagctaatttttgtatttttagtagagacggggttttgccatgtgggccagactggttgcaaactcctgacctcaggtgatctgcccgcctctgcctagcaaagtgctgggattacaggtgtgagctaccacgcccagcctatttagctcctgttttcagcagaaagtaaacattctttatctttcattttttaaattcattttgtatttaataattaaattctaaaagtgataaaaatatatacagttttgctttttctttcttaataaaatactttgtaaaagttagaaaataccagtattgctttgaatactgatattctagtatttttctgctgtcagctagacccactctaaacaatgaaggatcgatttctgaacccatttcaaatatgtgaaagtagaagacatgattgcatatataatgataaaagcacagtctaaagggtattattaatagcataccatggacacatagttgcttccttctgaccaagaacaaatgttaagagaaaaccaataaatacatttacaaacaggatttagggcccacaagaatagagtttgctttttaaataggaaatctatgcactgctttatttcaaaaagttacaaatttagtgcttgaaaaatccagcaggtaagcagcaggagtaagaaagtctgtttttggaactgtctaatggcaaatgagcatgcttctatccaggaagcatttttccatgaaagggatggagagagaaagaactggtatttacattccattctacacatctcagtactgcctgttcgtcttcttgaacttttctcatagtgatagtcatcaggggccttctcattaacaggatgcttgccatttggaaaggaccactcaggctctggcttctccctgtcacctgctttcaaggctcttctttgtttctatgtatgaggctgttgagctcctaatgataaaagtcggttgtgcagcatatattcacagccatgttggtaggcacgaaggacgtctcactgtctttcttcttgttctgctgttcttccccagctgggctttggcatcctccatggaaatgatattattttttattttagcattgatgctgaggtccaccttggggatgccactcagcatctggctagaaagcatctcctctgtcttctttgctgaggaaacacaaatgttttcttgaagttcataaaggcagtcctctgtgttcttcagcttgactttctgttccttatgttccatagtctctttcctcttcttcagctctgtctcaacgtactttattatgtctgcattctcatcccttcagttggtttctgcagaaaacaatgtccccagtgtcttcctcttcactgattttatctttgtcccttttgtttagtttctttaggaaactatggtggatacctgtatggtgggtaccataccacctattttcatatgaaaaggatcatccactagagtggtctcttcttgtaccttctcttccaccaacagggccacagcactcagcctgttgcgcctcttcctcaagttctacaccctcttgtctcttccagttttaatcaaacctcctctgagttctgctcatcctcttctgactctgagttggcctggcaccaatagaaagtcttctctttctatcttatagagagaataataatcggcacttctcaaagtattcaggtcaacaagacatttcttctcgaggcatctcatcaaatccacaggatctataatttcatttacatttagccaaggtctaatcaaggatttaggtttctaatttttatttccccaattgtttaatgtatacatttgagacgcaatattttgtgtgtgtgcatgtgtatgtgtatgtgtgtgtatagagagggtgtgtgtgcgagagagaagcatgtatgtgtgcttgtatgcatatcattttttcaagtactttcacatattgtctcgttaaattgttgaaacaaccatataaataaacaggttgcctattttttctccattttactgtggctcaaagaggtttcgtggcttcatgatgattaactagtaaagtatcagaacagatttgaaccctctgtttctgagtccaattttctttgccctgaactacatgtcttcatatagaaatcataaaatatagctgaagggatttagaattcctggagaaaagtggggagcaggaagactagatgtggttactcctctctgtggcatctcttcctcccctggctatagcaattggaacctgctgtggctgctgagcagagcccatgtgtgctcagtgcttccaggagctgggtaggtgttttgcagcctgttttctgactccttgagcagaacctaattattaatagctcatccaaaatttgagatccactttgtttcttttcagtcctcttagagattgaagaattcttgctgaatcttaatggtgtttttcttatcaaaatacttatacatgttaactgtaattaagttagaaaataatggtttcataaagataagaaattaataatagctgataatcccaccatccacatatttttattactacagttttgctacatattgtttctttacaaatataagaatttttaaatgaaatgatactatatattttttgcaatgtttctatgttttctccagaaatagaaaagtatcacaagtctagtcccatgttattaagtagtcttctataagaatatttttagtaacaatctcactgcatgatgtcagtgttcttccataagaacatttttaatgatatcttattgcatgatgtcagagtttgcttcacatactaggtcagaattttaaattagttctgttcttcatcattttagataggctatgtttatttcatttcctgtttattgtgaagaacccagccctaaccccatatagtacctggaagaagcaaccctgtacatcataagacacctcttctcccaaacagctgctaggatgaggctaatctattggcactcagcaaacaatcagtccaaatcaatcaagaatttttaactaagagacccagcaaaagcagtagagaagaggcatttcaaatgaaagatactttgcaacctaatacttacaaccaaaagaaccttgaccaaaacactgtgataaagcttgaggctgaatcttcattttccatattcataatttgttagaataattcttagaattgggattactagctcaattttatatgttttaatacatttgatgcatattgccaaattgctacctggaagagttgaaccagtttattttcctcctaatcaccactagaagttcctgtattttttccaatttgatttccagaatggtatttcattgtcttaagttgcatatctatgatttctgagtgaagttttaatattttctatagggattgaccatttgtatttcttctcttattgattgccttttcatatcatttgctcatcttttttgttggagtaatcatacttttctcattgatttaaaataactccttatatgttacagattttaatcctgatcaggaccttttttactgggagctaatgtgagttaggaggaagggcagggaaagatgggccaagggtttgggtgaaggtctgcagccaaaggaggattaggtcaggagacagtgcagctcctgactcctctccctcttccctagaccagcgtctttttccccagggcattcatagagactttcaaagggtatattgatatagatagtttttagggaattaatttatggattttcaaatttcctataacttgttcataaaattgactgcctgagaaatctttacccacctcccttttccagtagttttctcccatttcacaaaatcttgctatggtgatttacaatgggatataaaggactctggagctccaaaaaagtgataatttgaaatatcggggaggatgtcaagaaaatgagtgactcgaatccctgggtaaaaaaaattcctttgcaagtcaagtggttgctaaatctttgccttcaataaaatttaaagaagacacaattcagttgtcagttgacagattattaaaaatgttttcttatgaatcaccttgtgcatgtaactcaatgggaattcagtgacattgctatagctgccttcattctcatctgcacaagcaagatttctcaatgtttttactgagatgcattttaagagtttgatttttttatcttaataattacctgtctaaagttgtaatatattcatcttgttttcatcagttatgccccataatcatcaggacagtataagctacctaactgtaataagtaaacctaaaatttcaatggtttaacacaacaaacttgattgctcattcatctcagtttgatgcggatgaggagcccttcttggggactctcttccaagggtgaccaagatacctctgtttccatcttgtatctctgccaccagagtttctagttccacttgggaagatgagagagagagagaaactaaatccactttttcttttcttttttcttttttttttttttttaagacagaatctccctctgtcacctaggttggagtgcagtggtgtgatctcagctcactgcaacctctgcctcctgggttcaagagattctcctgcctcagcctccaagtagctgggactacaggcacatgccactgcacccagctaatttttgtatttttagtagagacggggtttcatcatcttggtcaggtctcgaactcctggcctcaagggatccgcctgcctccgccttccaaagtgctgcaatcacaggcgtgagccaccacgcctggcctcaatacacttttaactgcctaggattggaaacaagacttcatttctgcccactctcccagtggaaaactatgaaataaaaacttcctggactttcaagaagaaaaaggtgtggtgagcacagtactgtctctgccacaggtaccactggcaataatcgcaatgacagctccatccaggtgcattgtcttttaacagggccaatggtcacaggaaagaaacaaattgtaatttcactttatatttattatagaaaactaaggtataattatactaaggtaaaatttaaatactcctaagcacagaaagatcttttattagaataaaattttgtaaaagaatggaaataagaattcaaagggaaaaagaaatgatgtaaaattcccacctcttatcaagtggatgatggtgctatactacttatattccattagctatattataacaagctgagtaatagtattacttttgaaagccaatatttacaacagaccatatattacacccttgcaacctttgaagttttgatgaaaacttttagattataacataaaactgaatgaaggtatatagtttttcaaaattccctaggagatattgaacaaaaatgttgaagcccagtgtctttaaggaaatactcagtttgatttcattatttaaaagctaacaaaaaaaatcaactgttagtaggacggcttctgctgtactggatttgcagctccacgtgttgcaaaccactgtcttttaggacaccaatttctcaggaagtctagggataaagaattccaggtgcagaaatgttgcattttttggcagagttcatacatgaaggtaacaagcagagccgcaggctgacacgccctgcttagctttgtggtcaagctaccttcgggtttaagtcttctgttctgaagtctgtgaattcttattgccttgctcatcagctgatcatattgaaccactctcccagtgaaataaaaatcctaccactttccagaagaatctaaagcaagctgtctttttgactgctgaagatggcagttttagacaggggtctagctctcctccctaaaaaggcccattgacctttattgcaagtgaaatagcttatgggaacagtaaatggctaaccttactgtactataaaatagggccccctgcagcctctcctgtctctcagctttactgagaggcttataatagcatttctcataaaagcctctgtgccatttcccaggtgcaaacctttacagagaagtacaactagggagtttccaaaattgctcgaagagaagattgtctaaggataatgccaactatttagcaggtgtttcttgaccggaacttgagatcactttattttttgcatttacttttatgtaacctgtataagtggcaattggcgatatgctggaaacataggagaggaagcttacattaaaagcccattgaggacaccacctgatttagagatcaaaaaacaaatcctctatgaactaatgtcattaaagccatgaaaaagaaactttggtcaggctccaaaatatattttttaaaccatcctataatgcttgttgagcatcaatcatttgcaaggtgaactggctggtagatgctgcagaatcttttctaaaaagaaagatgtgagcagcttaaaattcaagaattccgagttttttcctaatcaacacccagtcacctctttcatgtatcctattttatcttcatcacagaattaattactacctgacattttcttttttatttatttactggtctgcctccgcacaagaacataagttccatgagtattatgattttgcctatttttttccactgctgtatccctggagttctgaagagcccagcatgttgtagactgtcaacaaatcttgtcaaatgactgaataaattcccaccctaagaaggtgcataaactcgcaagggttggaaaatgaagccccaaatatcaataatattcattaacatatttattcaatttttttaaagtgcttaagcatagcaataaaggccttggaggattgagggatgttatcttataggatgaatcaagtttcctggaggaagtgattaggttggactttgatttcctgagctagtgtgggtctggggaacaaagcaaagtgtagccaacacacagggaatatacatttggtttcctgcctatatttttatgtgaaacaaagggctgctagcaaagccttcatgatagtcaacaaattaataagcccctgttcagtatatctaggctgcctcatgcactggtcagtccttcctctaaatgggtgtccagatgattcctgtttctgctctttcaggctccaaaaaacttttttgttgtttttttttttggtttgtttgtttgtttgttttttggtcacagccatggcatcatcaaattttaaaatcctgtttttgttttttttttttttaaaaaggcaatctgtaatttaagagtaactttaataaatctggacccattgttagctccccagggcacatttaaaatatgtaagctgcatgatgtcagattatgctgtgattgtcttactagtaccttaaggacagaccatatgccagtgggtgggtagattagtacctcttagaaggaagtggatcttttcaccatcattctgggagttgatcacacctaggcaggggataaagactaaggaagtgggccttacctttatgtctggattatccttctcctctctctgggtaggtggccaatattgtccaagttccaaaaggcagaaattctcttgacatctgaaggaggatggagaatgaggcaggcaaccagcttcacaggggaccctaagaccagtctagagggtgctatactacttctcccccactcactgccaacttccagtaatgtcttgttaagttgttccatgcctaagtaatgtcttattaaattggttcctggcatcagctgtcttatgagataaagggaagaatctgtctcacattggttggagaaacaaaagaagaggagctcccctttccctctctttcccagtgaggctgggatgggttacctgcagtggtcacagcagagcaatgctatgctcagaagcatcttgtgaaagtcacttgcagtagtagcagcagggtagagagaacaaaccagacttgggaaagctcaggtgaactctgagaggccctggatccctggagaaatagtgggggacagttagaaacagaattattcctggcagtcaggccagggggttttgaagctctcaggtttactcattaaaaatagatgtgttccggccaggcgcagtggctcatgcctgtaataccaccactttgggaggccaaggcaggcagatcacctgaggtcaggagttcaagaccagcctggccaacatagtgaaaccccatctctactaaaagtataaaatcatctgggcatggtggtacatgctgtagtcccagctacttgggaggctgaggcaggagaatcacttgaacccgggaggcagaggttgcagtgagctgagatcacaccactgcactccagcctaggagacaggtgagactctgtctaaaaaaaagaaaagaaaagaaaaaaagaaaagaaaagaaagaaaatagaagtgttccagataaaactctctttataatattgtggtagtggtaaaaaaattacctattttttccaaggcagcatgttgtttaatgatgaaatacaaaaagccttcccaataatgtgaggaaatggtgccattgtttaacatatgtaactaatattgtttaagtactacccaattaaataagaggaaataaatgtataaaacaatgaaaaggatgagccaaagtgataattatttacagatgatatgatcgcatagctaaaagagagtcacatagaaaattattggaaacaataagataatccagtacaaaagctggttattaaatgcaataatcaataactttcctgtataaaaacaagttagaaaacataatgaaaaagttcccatttaaaatggcttctagaataataaaatacattagaataaaaataacaataaacatgcagaatatatgtaactgaatcttgataaaatgaaatggcattccctgtgtttagataaaaagactaaatatcataaagaagtcaactttccctaaatcaaatgattaattgaatgtaatagcaacaaaaataagatttcttggttattgttgaaatcacatatggcaaataaagatattcattacgcaactattttagctgcaatagactagaaacagtctgaatgtacatcaataagacactggttaaattgtggtgtattcccagaagacagccttgtattctgccatttaaaaagtaaaggagatctgcaggcctggatatggaataatatccaagatatgttgttaaataaaaagatcacaatttatatctacactatatctatccatatgaaataaatggcatcataatgtatctataaatatgtatgtccatataaattagcatgtttccttatttgtacatagttttcataattgttatctttaatggctatatgaagtggagtcctttctgtttcataaatctgtctgtccctagtgcctattataatgttcaggaagtcctaatgagagcaaagaatgatgctaagactgtaaatgctggtgccaaaatacctcaatccaaatgggaattttttaacctctgcgccttagtcttctggcctataaaatggggatgatgaccatttttacctcataggtttgacatgagaattgagacagattaagtgagattacagattaagtgggttaatctgcataaagcttttagagcagtgcctggtacatgatgagcaatcaatcagcatgagctattattattactgtatgaaataaccttagaaactttaagtcatttcttgttatggctgttatagatagtaatgcaatgagtagctctattaatataatgttttgcctctttttaattatttcattagattaaattcctagaaattagattgctggatcaaagagtaatcacaataattaccttttaaagatattcctttgacctcttcccttaaagaaaatttaatgatatgaaaattactagttgatataaaagagagagtaaagcaaataaatcatgtatttatttgaccacagcaaaagggagaggagctcccctttccctctctttcccagtgaggctgggatgggttagccatttactaaacaattatttagtaaacacctattttattcataaaactatctagacatcatacaaaaacccagggttccattcagttgattaaatccaacaaagatttcccactctactacatgcttgttccatgctgggagttaatcagagtaggaggaatatggagtggcctttgtccttaaaactcaaaatttatgcaagaaagtaagatgtgaagatagtatgagactctataatcaagcgccaaattccgtttttaaaagatcccaaatctgtgattcagacactggatattaggcatagtaagctaagcaaaaaagagtaggtgctggctggagccacctggcagacgtcaaagcattttcaaagacaatatccagttagcagcaaagaaagaagtatgttaccacaaaagtgatgaccaaattaggctctactctcttcttagaatctaacattttataattacttttaatccacccccaaatcaacaggacagctttgcatttgaatattatcagtagaaaatctttgctcttgctaaagcacatcctcgtccctgccagctggaaggtaaaaggaaccctcaagcttcagctgtgggctttagccaagggagtccaagaggtgtgctcaggagtagacgaggccggtagagggcctccactgaggactgtgcgtgtttatctgtttcggaagggctctctatctgctgaaagagcaaaatcatctccacttcactgttttcaggatgcagcgcaaatgtgtcttacaacaatccaaatctcacaccacaagctttaccactcttcagtcttctctcttttgtcttggagtcaggaggaagggggcaaactgccctcctctttgaggcgagcaagatcctctgtctcaaggaagccaaacctgaaatagaagcagaagccctttcatataattgaggaagacttcacagttgccagaaaccatttttgtaagagaataagtcccacataaagggttttctggcctttaaaattagcccaccaaatatctttcttgtgccttatccaggaattttttttttttctgctgccgaggctggagtgcaatggcacaatcttggctcattgcaacctctgcctctaggttcaagcattctcctgtctcagcctcctgagtagctgggaggccgccaacacacctggctaatttttgtatttttagtagagactgggtactgggtttcaccatgttggccaggctggtcccgaactcctgaactcaggtgatccacctgccttggcctcccaaagtgctggaattacaggcgtgagccaccacgcctggccccttatttaggaattattaaattgcctactatgtgcagaaacttgtgaattgtcaggctccaaatttcctcaaaaggctgaagcctggcaggcaatgtcaagaggagctgcttcttgcccaaacaggttccaaagcagtcaagtgaaattgtcttccttatatggtgaaaagtgccctgtccctttaaggccaagagatttggctgcagacagtccctgggaagtttgcgggcagccccatcctgtgtctgatccttgctgctgtgcaggtgagttcccaaaccttctctccgcaatttgccctctataatcgttctcatggcgggttagaaagactggtatgaaagggctagagaatttcagggtcagcagagatggtgctgtttggagaagtttgagttgaaggaaaaaacaaggttacaagggaaatgtgcagtaatgcagccagtgaggatgcatctaacttcctgtggggagaaggcagcaaggttacagaaggccctgaggcatttccagggcagggcagggcaggggaaacaaattcagctggggaagagggacaaattatagataagaccgtggagggataagtttagactcttgagctatataacctggtgaaccgcaagttaaaaccaaacatagctggtaggaaatactgcttctgcaagtgctgaaggctttccaggagctggagctacaggaccagactgcagaggagaaagtacatgaatgtttggaatgtctataggcctggaaggctgcagccttaaccctttttgcagcctggcttgttagccattagggtttggctgccacagagcaggaggtgggggtgcatgtgtgaagcactgcagtaggagactaaataaataaacaagactatgattgtggaaatgcatctctggcatcctcatagtaccacatgcagagaagagagattttctaagctcagattttctgtgtcatccacagaaacatctcagattttctgtgtcatctttcttccagcaaagggctggaagaaatctcatttaagctaattactgctccgtcatttactaactcagcttcttgaatttttttcctccatggtctggagcctggtacaatattaatttgaaattaactaataaaactttttaatagctaaagatttcctagcagaaatgtgtttctctctaagattgagatgtatatacagctggggttgggattttactgagagcttgaaaagagatgggtgtagtatagaaggagaaacacttgatggtcattttacgtaatatccaaagccgtttaactgagcctacagccaaaaaaggagtccacccaggaatttaaaaaaagagatgctaaattacagggcttggggtcctctttcctcctagttgagtcaaggtccattcatcattcagaggcagtggtttctctacagttgtgtgggggagtgaacaagaaggctggattaaaattccttacatactccatgccttttaaaaatattcattcatctgagtagtcactgaagaattcttcttattattaactaacaagtgctctatccacttgttagtgctttctaaagacagaatgttcatgaaaaaagattttgttttatcacgagggatttgttagtataagggttcctctcttctcctccgacttctgatggatgggcaaagtggtgattattggttactgaaaagaaagatctgttcttgactctaaaatcacaaagggctttactttggacctttctcattcagaaacattggtgtcccaagcaaaaagttaacttatgcattcacaatgtggaagacagcagagtgcatgggtatagttttgcttcattttgtaccaagcaaatccagaaagcagtgtcaaatacattgctttcaaatatagatgcacaaagaaaaacaaaattctatccttaaagctgaaaaatctctaaaagtaccatattgttattattattattgtttactttttttttttttttttttttttgtgagagggagtcttgctctgtcgcccagactggagtgcaatggcgcaatctcggctcacttcaacctccgcctcccaggttcaagcgattctcctgcctcagcctgctgagtagctgggatgacagacacgtgccaccatgcccagctaatttttgtatttttagtagagacggggttttaccatgtggtcaggctggtctcgaactcctgtcctcatgatccgcccacctcggcctcccaaagtgctgggattacaggtatgagccacagtgcccagcccatactgttatcttttataagataagtcaaggtatttccaacgaaaaaaaagatgtgtcttcccaaacatttcactcaatgactctccccgccctcagtcacatatggatcttacaacttcacacaagccacttactttatctgtgcctcagtttccagcctagaattgagcagatctgagttaaatttctagtttcttcatttatttccataaccataggcaaattactcagccagtctaaactttagctttcttatttgtaaaaagaatgaatgttaattaggatcagaagaccccagaactcggcataggctccataaatgctatttctcatttcttttcttgtcttttttttttttttttttttttctattgcctgggaaattacactgttccttggcaaaggaaataagttttgaaaacggaaaccagctgtgtagctcagctttaggactacagttacttcatcccctgtgcccattcccttcacagaaggatgcccaactcactgggaaacccattcctaatcatcaaccagtctcactgtttgaaagctcttcctaaagcaaacccacttccacttattttgtgttcagagacgtgaagaattgttgattgttttcttttaatataaaattactccatagtcttaaagaacaataataagttatcttagaatctctataaaggtggtctattccaataataagcttaaaaagcatttttaaaggaacttttttggttctcataaggcacctcttacaagtatttcaaaaataaccaattgctacttttttttttttttctgagatggagtcttgctctgtcgcccaggctggagtgcagtggtgttatctcagctcactgcaacctctgcctcccgggttcaagtgattctcctgcctcagcctcccaaatagctgggattacaggcacccgtcatcatgcctggctaatttttgtatttttgtagagatggggattttaccatgttggccagtctggtcttgaactcctgacctcaggtgatctgcccgcctcagcctcccaaagtgctgggattacagacgtgagccaccacacctggccccaattgctacttttctataaaactcctaacccattcacacagctgtcttcaagaacatgattatccttactttcagcactttcattgtttaggtcactttaagagtaggtttgccttacttgcaatgagtctgtgtatgacccaaaaaaattctgtcaccagtttagaaaggtggtgacaaatttcagcaacagaaatattccactggaagttcacatcccagcctatacataagctgggaatcaagtatgccatttttaactaaacgaagagcaggtcacacacatagcccatcttctagtcatggattaacacagcctctgtcaggagacgtgttgagagtccacacttgtccacttaaagtagctttgaaactctgggctagttcctacatgtgtctgagcctcgatctatggcctgcataatgagaatgataataacacttatgcacgtggttcagggaaagcatgaaatgtgccaggacaggtgctcagtaattatgttggatctgaatgcccaatagtctaacaaagtcttgtaccttaataataaggtaatggccccagatcttgtctacacactttagaacaatctgcaagtatggatatgtttctaaggatgtgtaaatttaatgtttaataaaaatgtaagttatgtttctaattaggtggaatcaaaaagaagtcgatgctgaggcaaccatagacctgctacaggggttaactgtggaaacagcctacaaatgcagatgtggcttaaaagctgctggttctcaaagagttttggattggctgtgttccttaaaaatattttttaactttttaccccaaggcaagtgtttctgtgtctggtacactggcagaaggagttagaatgggggaaagcattaaacagattgaaatgagagatcctagtgcagttgaatctcttgatacatctttgactcccttcttccccaactccccaactattctccttaagcttttcagatgtaattcattcatgaaaccaccaagctggggaagcttgaacaagtctacaccagcttcttgccttcattcaaagctgcacttgaaacaatcaggaaccatggctacctacccttccaagggagagagactgaagttcagtctactgcatgcctgcaccggggctgcactggggacgttctccccacacctacccttgtaatacaagcccatattcttttttttttttttttgagacggagtctcgctctgtcgcccaggctgaagtgcagtggcgcgatctcagctcactgcaagctccgcctcccgggttcacgccattctcctgcctcagtctcctgagtagctgggactacaggcacccgccaccacgcccggctaattttttgtatttttagtagagacggggtttcaccatgttagccaggatggtctctatctcctgacctcatgatccgcccacctcggcctcccaaagtgctgggattacaggcgtgagccaccacgcccggccaaagaccacattcttttagtgtgctctgggtctgtcctttgtgtttatggcaaattgatatcctgtctatgggaaatttccactaaagtggggagtgatgatatggtcatagcctctgtgaggggcaacacttccttgttttcggcctgattaatcatcaggtgagtagacatccttctcccctgactttatcacttctattatccactcctgcttgcccctctgatgcagtggctcccaaactagaaagcatacatcagaattacctggaagctttgttaaaacacagattgccagtctctatccccagagtctctgatctgtaggtctcgactggggccggaacacttggaatttctaacaagtttacaggtggtctggggctacacttcaggaactggtcctctagttcaacaataaatctcactgtagtgttcccagtaacttgtacttactcttgcctttctatataatacctcttccatttttggaggtgaagtatagccatctcaccacagttatgtgctactattattgaattctaattgtaacaggcactgtgctaaagacacatgttatttcaactacaaatttggtatcattaaacagaaagaggttaagtaaccaagatctcacaagtgataaagaaaagatatcaaactcagatttatgtgaaaagtgtttactctttccatgattccagggctggcaaatagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggtatgtgttgtatttgctgtccccacatgatgctttgccttgttcattgatcaattttgttaggacctagaatcagttgaaagacatgtatttaagtttgttccagaggaaacaataaatttatttccttgtctcttcctttctctggaaggtaaagttaagtttttgagcctatatttgagaaggtgtaataaactataaagtgaaatgaaatatttatggtttttgtatttgtgtctaatgcatgttttaacatgattgacacaatgcattttgtaggtatttttctggaaaagtcaatcttttagaaattgtttttcagatcttcaataaattttttctttaaattacaaaaaaaaaaaataaagaaatgcaactggtatatagatagtagtaaccaacataagcatgttgctctaaagtggctgggacaaaagagttatgttaattatagtctttgcatattatgtctttcaatgtgacctatctaatggattgccttatattgaaataatccagcatgacttagtaagaaggtaatgacatttctagtttagttcctctctccatgttaatattcactgtgggacttgttatttttagcgtcttagtgctttatatgaacaatgaattaaataatgtttttctgctgcatcctaacatttattataaatgtgattaaatgacatataacttaatggcatctattttatttgatcaacaaatatttacaaaaatgtatccccaggcaatgggggtataacaacaaacaaaatatattgttctcatggaacttacattccagagaggagagagagagacaataaatgagtaaacaaggaaattgtatatagtgataaagcgtgttcagtgagagagagaaactgtgtgtatttgtgtgcacaagtgtgcgtgtgttttgctcttttttaggtggtcagggaaggcctgactgaggaggtaagatcgaatatggaaaagaagccaaacatgggtcggtctgggaatggagcattctaggcagagaaaataggcaatgcaaagatcctgaggttcaaagtccataggagccagattgagtaggctagtaggggtttcagctgggggtgctgcaacctctctatttctgcctagaagatgtttgaagatgtgcaggtggcaatttgcatatacaatgctagagttgagggcaggacaccattggcttctagtggacagggaccggggatgataaacatcttgcactgctcttgatagactcacacaagatttgtcttgctcatattgtcctggaaaaaatgtctgtattgagaaatcctaaagagcctttaaagccaggctaagaagtttgatttttatcctaagtacagtgggaagctattggagagttgcaagctttaaaagacaatctctcaaagatcactttggctactgagtggagagtaaattgtaagggacaaaggtgaaagaggaacattcaataggaagctttttcagtgtccacaacagagatgacggtggcctagacaagaggagtattggtgaaggttttgagaagtgtttttccttcaagaagaaggctgctaaataacatataaaatgctgtttcccatgaaacctctattctatctttttctttttccttgagagatttttttcagtttcagaatcctctggtttcctctacattcatttaagagaattttgtggcaccaaattacagaagaccttgctctttcaaatgcaagtccttatcttcttgctctttaaccttgcatatctatctgcatttcaagttgttcattgctcagaaaggtaatctatttgatttgggtttgtaaaaagagacaaaattacttgtgcttcttgaataacaatatgtgatttttttctctgagggtcaatatgaattagcctacataaatcattttactaaaccggtgcctaattacatgaacaactgcgaccaagtctacatttattctgttgaaagagtaacattgaacatcaaaatctcttgcagagattcaggcatttcagtacaaatgttacttaggcattaaagcctcacaaatactttccaggtgcattggctcctccctgacaaaggcaactcagcttccaagacttcagaaaattcttactgttgtcatctcgtctctcctcatagccaactcttctttctgcacctccacagcaagtggcccccagactgacctcagtgtgtctctgcaaatgcagagattcacaaagcagcaatgtggaaacttgtcagttcacttggagaacaactcaattctcatttgaggggaggagcatcctgtccccaggctgagctgaagtgggtggcgagaaaagagtggggaggagctggctgcaggccatacccacactggtgaatggttccactgagtggtaggtgcctctgcaatcaggatgaggtcttccccaaaaggttgttgtgtcctgagaggagagttggggagtcacctaaggaacactggagaatggatgctgggcaggtggaacaacacaccacagcttccaactaagctgaggaaagcaggtgcttgccaacccacagcctgtcttccagtttctggatgaaactggagaagagagacagaaaggagatagagtcagccccctgcccccaaaaaatccaatgaaatcttctttaatttaaatccatcacacaagctacataagtcaagattccaagaattaaaaaagcaagtggtcttattttactataaaaatgaatctctgccttcatctctgggccacaggtatgcccctaagagagacaggccacttcattgtgtagccaaaaaaggaaggaaaccagaattgtatattcaaaaaaaaagaaaaaaaaaaaaaaaaaaaagaccaaatgctttgcattaagatatcctatcttagctattaattaggtatgcacatttgaactaggtcaccttcctgggcttcagaaataaggagctgaatcaagttttttcagaccctgatgtgctctgagtggatttataagttggctcaagctcttcgacactcccctaaagcctcttgcagaccaaaccaagtcatccacctcacccaactcccctttcccaacactgtatttccttttttctttgaatatccctctccctccactagctcttaagctccctgaagagaggtattggtatcatggctttttctttgaatctccagtgtctggagagtaccagacactcattagatgttcaataaatgtttattgttgaatgaatggataatgtgaatataaaaatagagaagaatgagcccaagctaattcaaagctcaagagcaagctttgcttaaaaccatatattctggccgtaagattctggactccttaaaattaaaaaaaggagagagaggaaagagggatttcagatattatagcagtaattttcagacatcacagtttctaataccccgtgtctccactgacatgcaccagtttcatggaattttagaaatactagagttttacctagcttttatggaatgtcttatatttataaagagctagtataaaattgctgagtagacatttctagattccttactctcaaactgcatgcctatttaagctcttcccagaataaagaaaacagcaaatcaaaaagtttaaagctgccttcaccttttcttcataagctttgatcctttaatttatttaaaatatgtaaccatcaaggcctcattagaattgctaaagaacatagaaaaggccatatgggatcaaacttctggcctgtccagccaagttaccaaaaatggcaaagtcttgctggtgtggtgctgagaacaagggtggaaacccagagggcagcagaggtggcaaccccaaacaaggtctggttccaggagtatggatttgaggggactgagatagggtgcagtgtcagaacttttgggtagtggccaaatatttgatcagtcttagactaatcagggagcactgtgcatgagggattccagcctcagaaaaagagtcaaaaagaaaaaggaggctgggcacggtgggtcacaccttaatcccagctcttggagaggctgaggtgggcggatcacttgagatcaggagttcaagaccagcttggccaacatggtgaaaccccatctaaaaatacaaaaaattagccgggtgtggtggcgggcgcctgtagccccagctactcgggaggctgaggcaggagaagagtgtgaacccaggagagagaggctgcagtgagccgagattgtgccactgcactccagcttggcaacagagtgagactccgtctcaaaaaaaaagaaatgcagttgattgcgcttcttcctgtgctagggctgagcaaatgctgccactgggagttatcgcaggaccgggacaagaagacactgcccccaaaagtgtggaatctccagtggtatcccctggggatttcttcaaaatattgtccatgaagcaaggaataacaaatgcctctaacttcatcattgtgatgtgccatataaggctcgtccatccattcttctgagctctgtttgcaactcaagtagcaagtgttaggaactcacttatttttattttttttgcccactgtatacagaagcaagtcctttggactcttcttcatgctgtcctggtagtgagggaagggacaaccatgagaccacggtataagtatggggttaatggcaataataaaccttattctgattcattttggatacactcttttttttctttttcttttttttttgagacagagtctcgctccatcacccaggctggagtgcaatggtccgatctcagctcactgcaacctccacctcccgggttcaagcaattttcctgcctcagccttccaagtagctgggattacaggtgcctgccaccacgcctagctaattttttttttttttttttttttttggatttttagtagagatggggttttgccatgttggccagcctggtctcaaactcctgacctcaggtgatccacacacctcggcctcccaaagtgctgggattacgggtatgagccaccacgccgggccttggatacactctttagaggactagtgaattcaagtgcattcctcctaaaactgactatcttctttctaactgctgtaactgtaaaagatgaagaacaagctaatattctcctgcctttaggcttcaatcaattccttatgagccttcatctctcctaggctgaatggattcttaatctttccctaaagggtagttgctctagtgtttgtcattttagttggtttttctgagtctggattagaaacagaacattaagacattaaaaatatccatacacattaaaaatatctctatgttttaaaaaataaagagcctgccaaaatctggaaacaacacccatgttcttgagtgggtgaacagtacaacaaactgtggtacatccataccatggaatactagtcagcaacaaagaggaatgagctattgatacttaacaacaacctggatgaatctccagagaatgataatcagtgaagaaaataatcccaaaatgttacatactgtatgattccatttatataatatgcttgaaatggcaaaattacagagttagagaacagattaatggttacttgagtttacacattttaaaattgaatttccttttatttcctgctcatatacttaaactcattagtttgaatcaagttgtaaagagctggagaacggattagtacttagagaatgggggcagaagagaactggtgtgaccatgaacggcaacataatgggtccttgctgtgaagagaatgtcttatatcttgactgtgtcgatgtcagtaccctggtttgatactgtactgtggttttgcaagatgttaccattggtaggaaaatgggtaaagggcacaagggatttttctctatattatttcttaaaactgcatatgaatgcacagtaatatcaaaattaaaagtttaatttaaaaaataactagttaaatgaacatagatgaacccctaactcacagtctcaaaagaagaagcaccccccaaatttttaaacagtatatatactgtactgtatagtaaaactatgaggaaaagcaaggaattaaggtgaattttaggatagtactaagagggaagaggtagaaaaggaaatgtcatcaaggtgaaacacccagaaggcctcaaaggtaccaaacaaaatattctgacttaaagtggagaggtgagaaatgcagacattcatttaaacattattctttaaactacacctacatgtttttatattttgctttgtatgtatatttaaaaataaaaagataaattttaactctccctaaaacataaagacccagtgtctgaaagaaactgatcaaaaaactttaaaatgttgccaaaatgaggtcaataagaccttaggcaaaaatttaaaatataacccattaaaaccagtacagacagaatcaatctctttctttctctctctctgtctgccttcactggtaaaaattttgctgactagaaaaaattctgtaggagtgaggagcactagaacttatctataaattacatttcagagaaatacttttccccctgcctatcttgcctgccaaagcagtactgatttagcacattttcctgtccaaagttgaaaggttaaaaatgatgcctacctctctggaagctggcattctaatagcttggtgttcatggtaaccattggacagaagcctgttgaacatcagaaagtgttcaatggggccaggcgtgttggctcacgcctataatcccagcactttgggaggccgaggcgggtggatcacgaggtcaggagatcgagaccatcctggctaacacggtgaaacctcacctctactaaaaaaaaataatacaaaaaaattagctgggcgtggtggcaggcgcctgtagtcccagctactcgggaggctgaggcaggagaatggtgtgaacccaggcggagcttgcagtgagccgagattgcgccactgcactccagcctgggcgacagagcaagactccgtctcaaaaaaaaaaaagaagaagaagaagaaagtgttcagtgggactgctgtgcaatcctgtgccaggtgagcagcttgtcctgccctcagcctgcctttccctatgtgtatgtctataacaggcctgttcattacactctgtgcaccagctccatatttcttatttacttcactgtttacatgcctcaaatagctcatttttcctgagctcttgcttagccaagttccctgcatttggttcctttgatctttctgctaaaatcaatatcttcctctaattatcttctgttccacttctttgaacctcttccagttgcctccatttctcaaggagccgggtgtttaataaagaatctggataagactcaggcagagtcaggtaaatgcccctgcctgctcccaggtagagtgttgcctcttctttaagcgggagagatggtttactaaaaattccagagcccagacagtgtcctactatggcagatgcctagtaataatcaccaaatggaggaagtaattggaatctcttttaaatgtgttaggccatattctaacttgcacttcatttgctttcccattccaccctcagcccaagtctctttctgctttcaggtttttcactgcagtctaatagtttatttcatagcttatgtcattgatgctttagtttacacattttaaaattgaatttcctttaattccctgctcatgtatctaaccttattagtttaattcatgttgtaggattttcctagtgaccttgtttagtagattactattatttagaaatcatcctattttatcctcttctccaaatgactcacagtcatgttaatgtcttagtttttatttctctttattagagagtagattttgcctctatatttgttaatttttggtgtttgtctaattagtcacagtgcaaggtttatcatatcctatgactctgatacaggtttgggctgagaagaataaagaccactgtcttaaaatgatatgatatctgggacttgggctgtgggggtaattacaatgagcaaataggtgaaataagattgccatggggtgatagtctctagagtgaggttataggaacatggggttcattgtactatacaattacgtaaatgcttggactgtttccataatgaaaaattatttttagaaaagcaaaaaatatagaattatagatataaaattggccctatgaattcttcccttaagatttacagaaggggaattcctccatccttctctacctcatcctatcattgtcttgtcatttatcagtggtccagccatttcttttcattcactgagaagtttagcacttgctttttctcttcctttcttttaaaactctagttctcacgtgggagagtacattgtcctgatgtgtggcttatctagtgctttatatccacaacactaatgatctgcactctcactcccttccagtcaccactactccttgattagactctaaatcattttataaatggtgcagatctatactgctgactgtctggcactctggctaaggcctttaggttatgttttgatataaaatttagttttttttcaacatcagtcaacacacaaaacacatataatccagagatttctgtcttaaaatccttcagatgtctttatcaatttcaggttgaaagcaaagtttaatattcttcacatccactcttgcttttcctaccatttccagcctctttccctatatcctgcaatattcactctctttccagctattctataccaaactgccttcacttgcgggagatggaccatggtttcttacatctccaagcttttgaccatactgttcccccaaattggaatatccttctgtctttcagcctttggggaacttcagcaacttttgattatacctcaagacccaattcaagtatgattcctttgggaaggcttctttgagctgtccacattgagttaaacacctctccaataccttttccatagcactcttttactatgcccaccctaatactttgaaacccaactgttaactgtgagtactttttgtttcctttatgggccatgaactctttgacctctttcagctctctctccccagatatccaacccagtacctggcacatagtagatatttggatgaaacagtaactgcatgaatagagaaatggataaatgaatactatgtcatctccttaaagtagcacctccctaccaagggacttctctagaagtctgggccaacagtcttggatctgagaagctcctccagtcttttcctctaaactcctctccttaacccacctgatgcatctggctccagctacataacccaatcttccttgtctctgtgagtccttcctatttaatgctttatctagacaaatgtttcccagagtgtaggagagggtaatttttaagtgatactcagataaatgtcttttggcagacttgtatttacattcatttatatttgggcgaaaacttagcacataagacctgtgatttcatgcagaatgttgtttaggatgagacaaatataggtagggccaaggtaatcaaccttaccctaacttcataaagcagggacgacgtgcccaagtatattcacagatgttccaagctctattagtgatcctggctgtctatgcttttcatgggtatgaccacgggttcagtactcatggccatgagaagcatagacagccaggaccactaacagggcaagactcccatacactgaattccacaggcatctgtgtgttttattcagtgatatgttgaaatgtcactgcctgaagttgcagaatatatatgtgtatactaaattataacacataaaatagtcaaatatcttttgagctttccaaccacatccccatgcaagttcagatttttaatgtaggttaatataaaaatggacagatttgtctcattaaagtggatcctcaactttgtctgaaactatcaagtagaatatccaactattttgatcataaagtttcatccttctaataagaaacatcttcagccatacattttatgtccattttatttgttccattttttgtttactatttttaccttttgtttttaaaagtttaataacatcatttttatagtttgtctcatcaaatctaatatgccatttatgtgtaaagcacattattttatatgccactaagaacaagagaaatgttgccaattataattgctagatgccattgattgtaagttccaccccaatttcagagatatcaaaattattttttaaagtgtgtctcaaaattgatgaatcacagtatatgtgtttactgtgtaacgtaactcttctacgttagcaagtgatatttatatttcattgatagtactaatgtaaagtttcccttttgaataaatttaatttaaaaatgagttgattcaaagaaaagaattatataagaagtagagatggagtataatatggcaaaattatggaggtgtaccaacatgataatgacttggcctaactgcctaggcccagatattgccctttggccccatgtgccagctcatgccaacccctgccaccctccttcactgtgcccagctcctacctgggctaccaagcatgggagcaacgtttgggcaattatactaatgctcaggatgaagaatgtggctgtaactcaccaaagtcattttatgagagtcaaaaggaattcctaggtaatagactcatttcaagtattggaataatctggacttgcccctatttaaataacaagatactcagaggtttctgttttgaccctgttctccaagaagtaaagaaggcaaaaagagcattttagtctctgttgctggataatctagttactaaaaatgggtaaccaaacactaaacagttcagtgattatgaaaccaaagaatggtctactttattttttacaatagttaccaatgaaaatgattaagaataacttgaaacaaaatgtgttttactgggaaagtacaagaagcagctgggtacggtgtctttcgcctataatcccagcactttgggaggctgaggtggacagattgcttgaactcaggagttcaagaccagccttagcaacatgataaaaccccatctccataaaaaaaatacaaaaagttagccgggtgtggtggtgcactactgtagtcccagttactgggggagaggaaatgtatgcaactgtagtcccagctactggtggggtagcggggagttgggaggccaagggcagctgaggtgggaggatcacctgagcccaagaaggtcaaggctgcagtgagctgagcttgtgccactgcactcagcctgggcaacagtgagcaaagtgagacccccatctcgaaagagaatttaaaaaaaaaaaaagaagaagcaacagcagctaatttcctacttccaaaataagaaaagtgaagagagaaccattttagagggagttgaggaaagctgtgaggtttccattgggaaacaccatctccttggccattgctgtggatttgtgttcatcatgctcccagctcccatcttgcactaggtcgcgctttaggttgctgggcattgtgtgcaacattcctggagagccatgcagaaccccttgatttactcggtgcttattcttgaaggttattgtgaatcattaaccagaatgcaatagagcagaaggtcacaagtcatagaggctccgcagcttgcacatagcctgtttttgcaaacttaattttgaaggttttaatgtaggtgtaattgaaaagataaattgaacacatatgcatattctaataaaggtattctttggagtcagcaaacattcacatcctattaagcatcaatgaacgtattatagtataataaagtggaaaggtcttagaagattatttataggctattagttattagtgtaattttaaaacataatcagtaacaattagcaaaattgataatattggatatacagtggtttccactcactagtactagtaatactagcaataattctatatagtaatatcagttgaaaactaaacctcttctaagttctttgttatccttatgggagttcttgtttatcagatcattggggcatcacttcactgaaactatttccttatattcataaacagtattgacatcatatactaaatttagaagtttattcatagagtagaataaagttataagattacttcaataccctttgtccaagcagatgcactggtcaaaaagccaaatatatataggtgtgtatgtgtgtgtgtatatatatatatatatatatatatatatatatacacacacacacacacacacacacgtatacatatatatgcacatatataatttatatgtttgcttttcagttttaatttttgtgggtacatagtaggggtatagccaaatatatttagaaggtggaatcattaggacttggtgtcttacatcaggtcccctacaagcagatcctgagatggggatttgggtgctgatgctttattgagcgataaacttgtgagaaagtgagagaagtaggatagacagggaggaaatgccaggtaggatgtggaatcagatagtctatccttggcctgatgaaaatagaggaataaatttcaccataaaggacacctgtgtgtccttcacagctaaacactcacagcagctgggggtagggttgggtgtatacagcagccaggaacagggatctgcttgaaacactaccagcattaaccacatttggtgatggggcagtgggtggagggagacaaggatggctcccaaatttgtggtatgaacaactgaatagcttcttgtatataacagcaacactcccctcataatatcaaaaacctaagattttagaagaactattaaaagactcttcattttccaaacaaacaaaaaaaaattccccttagcttttacttttctaggttaaaaataacaactctttgacataattgcatgggatcaatttcccattaaaaacacataaactttttttaaagtattgctcttttagactttttccatttagtcggcttcctgttgaaaatagatacaaactggttctagtactctaatgatcgaagattcacctacagttccaatattatgttagctttttatttaaaaagtacgtatgcattgttgtgcattcatcctttagtccaggggtcagcatactgtggccagtgggccaaatctatcctgtcatttactctttatggcctgagagctacaagtttttacatttttaaaaggttgctttaaaaaaacaaaaaagaatatgcaacagagaccatatgactcacaaagccaaaaatatttaccatctaatcccttacagaaaaagtttgccaacctctccttcagtctgttatgaccccatagtgtgctgatgcagtctatatttggaaagaaaatctgatattcaaaaacttcagattagtggatgatttatggaactataaaattattgttttataaagggattcatcacagaatttatagaaattaattccagctcttctgaacaattatttctttttttttttttgagacggagtctcaccctgtcacacaggctggagtgcagtggcaggatctcggctcactgcaagctctgcctcccaggttcatgccattctcctgcctcagcctccagagtagctgggacgacaggtgcccgccaccatgcccagctaatttttttgtattttttagtagagatggggtttcacagtgttagccaggatggtctcgatctcctaacctcatgatctgcctgccttggcctcccaggaagtgctgggattacaggtgtgagacaccacgcccagcctcaaatctcatgttgaattgtaattcccaatgttggaggtgagccctagtgggaggtgattgaatcataggggtggatacttcgtacatacttcatgcgtggtttagcatcatcccctcagggctattctcgtgacagtgagtgagctgtcacaagatctggttattcaaaagtgtgtagcaccctcccccacccacccacaacccaggcccagctctatttcttcctcctgctttggccatgtaaaatgtgcctgtttccccttcaccttctgtcatgattgtaagtttcctgaggcctccccttctgtacaacctacagaactgtgagccaaataaacctcttttctttatagcggtgcaagaacggactaaaacaccaccaatcttgtgattattgcaaagaaactaaaaaatacaaatagatacaaaggtaagaaatcatttgcaatcttaccatccatagttaacatctgttaacattccactacattttttttctaggcatataaccatttaatttttttaatgtgatcatgttgtatgtataatattataccctcttttattcactgtactagtctgttcttgtattgctataaagaaatactggagactgggtaatttataagaaaagaggtttaattggctcacagttctgcaggctgtacagaagcatgacagcatctgcttctggggaggcttcagggagcttttacttatgacagaaggtaaagtgggagtgaggtgtctcgcatggtggaagcaggagcaagagggagtggggtggggaagtgctgcacacctttaaacaaccagctctctcgagaactcactattacgagaacagcaccaaggggatggtgctaatccattcctgagatatccacccccatgatccaaccacctctcagcaggcctcacctccaaagctggagactataattcaacatgagatttggtagggatgcagatccaaaccgtatcatttcacttaatgttataattttcaaaagcatcttatttgacttcatttattccccagaattaatgtgtcacaacgtatgtaaacatctattttttgacatttgaggttgaagctaatttttcactacggtaaatgctacaatgagcctcttcgtgcataaatctagatcctcatttctgtgtccctaggctagattattagaagagtaactattggcccttccccacttctgctcctcatcttccttacaaactcatgcttcttctcctagttctataagtgctagaatccgttaggactagaaacttggccttcttttctcactccatatttgtctcaagatcatgtcacctaaaaccaagctttcaaataccatccatatgctatgattcccatctttatatcttcagccccagatctctctgctaagctccaaacttacatagctaaatatctacttgtcatctccacttgtatgtcttataacatcttagatatagaacgtccaaaaaggattcactgtctttcctgtttttttctcccctaccaaaaccttctcctcctactgcccatttcagtaaagtgacaccatctttccaccaagttgcttatgatacaaaattggaacccatcagtgacatttctctccctcaccacccccatctatttagtcactagatcctgttgatttgacttcctaaatatctttagtatttctatttctctctgtcttcccaatcttcattgaatctaccatcatctccttcctggactgctgtatgtatttcctaattagtctctgcacccagccttgtcctgacctattcatttctcagttctccaccatgcagaaagtttcaaaaataccagtctgctttcacaatccttgagtggctgttaggataaagatcttagttgcaacccctcctcactctccaccatcagcttaccactgtttcttactccagcttagtgattccttcccgttactccaatgtgttaagcttcttccatcctcaaaacctttattcaagcctttattcaagactttattcacctttccctccctcttcagctgctcaacccatttcctgatacctcccccagtgcatgcactaaccacatgctctcttagcatcatttgagtccactttttgggtacttattgcaaactgtaatttaaattgttgtgtattttttccctggaatgtctgttcctccactagacttaaatcccacttggagaaaatagcatttgtctctcttaccactttatccctcagtgcctgacacatagtagctgttcaataagtatgtgttgaattaataacaggttatgggatataaacttcataaagacgtttaaaacatgttatcaaatatcattccagaaagtttgtatcagtcaatttataaacctatcagcggtatatgagagttcctttgatcacacctatcctgacacctggtattagagttttaaataatttttaaatactctggtaggcaaaatgttacctcattgttattgaaatttttcttgattattagtgaatttcaaaatttttcacatattgatagcctttcctatattgtctatgattttaaaattcatgacatactgcttttattgaaccgttctgttgggatattttggaagtttatttaaatatctttatacttacaaaacaatgccaaatctacttagcttcatctgaaggcttgcacaaacttgaataaatgaacttgctcctaaaagtttgtgtttagtcactgattccccctgactttggatggctctaagacttctcatgtaaactaggacacttttgagagtgaaggagggtgccattaataattatgccaggacaacaagtataaagcaggaccatcctgcccaagccaagatgtacagtctccctgactctttcatgttcatgtagacttggaactctggaaatctggagctaagagctggggtccaagtggtgatctagggatgaattgaggatgaaacctgcttttcattccgatttttaatttggatgctgtattagtccgttttcacactgctgacaaagacataccggagatgcgcaatttacaaaagaaagaggctggccgggtgcggtggctcacgcctgtaatcccagcactttgggaggcctgagtgggtggatcacaaggtcaggagatcgagaccatcctggctaacacagtgaaaccccgtctctactaaaaatacaaaaaattagccaggcgtggcggcaggcacctgtagtcccagctactcgggaggctgaggcaggagaatggcaagaacctgggaggcggagcttgcagtgagccaacatcacgccactggactccagcctgggcaacagagcaagactccctctcaaaaaaaaagaaagaaagaaagaggtttattggacttacagttccacatggctggggatacctcgcaatcatggcagcagggaaggaggagcaagtcacatcttatatggatggcagcaggcaaaaagagagcttgtgcagagaaactcctgtttttgaaaccatcagatcttgtgagacccattcactatcatgagaacagcatgggaaagacctgcccccatgattcaatcacctcccactgggtacctcccacaacacatgggaattatggaagctacaagatgagacttgggtggggacacagaaccaaacaatatcattctgcccctggcccctcccaaatcttgtatcttcacatttgaaaacgaatcatgccttcccaacagtcccccaaagtctcaactcatttcagcattaactcataagtccacagtccaagtctcatctgagataaggcaagtcccttccacctatgagcctgtaaaatcaaaagcaagttagttatttcctaaatacaatgggggtacaggcattgggtaaatacagccattccaaatgggacacattggccaaaacaaagggtctacaggccccattcaagtctgaaatccagcagggaagtcaaatcttaaagctccaaaattatttcctttgactctatgtctcctatccaggtcacactgatgcaagaggtgggttcccatggtcctgggcagctctgcttctgtggctttgcaggatgcagcctccctcccggctgctttcacgggctgttgttgagtgtctgtggcttttccaggtgcacagtgcaagctgttggtggatctaccattctggggtctggaagatggtggtcctcttctcacagctctactagacagtacctcagtaggggctctgtttgggggctctgaccccacatttcccttccacactgccatagcagagattctccatgagggccccacccttgcagcaaacttctgcctgggcatccaggcatttccatacatctttcaaaatctaggtggaggttcccaaaccccagttcttgacatctatgcactcacaggctcaacaccacgtggaagctgccaaggcttggggcttgcaccctctgaagacacagcctgagctctatgttggcccttttcagacatggctggagcggctgggacatagggcaccaagtctctaggctgcacaaagcacagggaccctgggcctggcccacggcccacaaaaccacttttaccccctaggcttgcaggtctatgacgggaggggctgctatgaagacctatgacatgccctagagacattttccccattgtcttggggattaacattcagctccttgttacttatgcaaatttctgcagccagcttgaatttctcctcagaaaatgggtttttccttttctactgcattgtcaggctacaaattttccaaacttttatggtctgtttcccttttaaaacgtaatgcttttaacagcacctaagtcacctttggaatgcttggttgcttaacatttcttctgccagataccctagatcatctctctcaagttcaaagttccacagatctctagggcaggggcaaaatgccaccagtctttttgctaaaacaacaagagtcacctttgctccagttcccaacaagttcctcatctccatctgagaccacttcagtcagcctgacttaatgtccatatcactatcagcatttttggcaaagccattcaacaagtctctaggaagttccaaacttttccacattttcctgtcttcttctgagccctccaaactgttctaacctctgcctgttccctagttccaaagtcccttccacattttctggtatcttttcagtagcaccccactctactggtacaaatttactgtattagtctgttttcatgctgctgataaagacatacccaagactgggcaatttacaaaagaaagaggtttattggacctatagttccatatggctggggaggcctcacaatcatggtggaaggtgaggagaagcaagtcacatattgtgtggatgccagcaggcaaaaagagaccttgtgcagagaaactcccatttttaaaaccatcagatctcatgagacctattcactatcaccagaatagcacagaaaagagctgcccccatgattcaatcatctcccatcaggtccctcccacaacacatgggacttatgggagctacaagatgagacttgggtggggacacagagctaaaccatatcagatgcctttgtgctgtgtggtttagtgactttaatgactcagacctggaactccctgtcaccggtggtgaccccttcactcatttacctcacccgcctggcccctggaggcacctaagttacagcccatgaaattctggcagtttctaaggctcagacaatttcatacaactctgctttcgtgaggaagccagtggcccagagagctagctgcagggatggtcttgcccataaacacagagctagtcagaggcagagccaagtatcctgaagagttctcctctgtcccaccaagctacctccatgcctcctgctgtgtggcactgacaatgctattttctgacgttataaggtttccagaattatgtcaagacatgaccaaaacagttttaaattcctagagtatcttgtgaaaatgttcctctttgataagctaaacactttaaagtagaaggcatgcggttttggagacatttcatcttatattagagtcatgtatacatgagcttccatgcctatgacttataatgcttccctgacccttgcagttgtctacaaacttccccacctttttctaaatgcccttttgttcaatttattctcttcaatgaagctcaaaaagtaagttcagagttacttacagacttacatttttttttttccaagacagagtcttgctctgtcacccaggctggaatgcagtggcgcaatcttggctcactgcaaactccacctgctgggttcaagcaattctcctgcctcagcctcccaagtagctgggattataggtgcccgccaccatgcctggctaatttttgtatttttagtagaggcggtgtttcactatgttggccaggctggtctcgaactcctgaccttgtgatccgcccgcctcagcctcccaaagtgctgggattacaggcgtgagccaccacacgtggcccagacttgcatttttgagaattgctagcaacttaaggaaagtagaatatagtggcagaaaccttctggaaaaagaaaaaaacaagattttggttgaatttttgtcattgccatctaatctgaggaatgactttattttaaaaagaacagcaggctgcctcttccaatcctgtcaagagagcacatttcctaccaatggaattcttgcagagattctgtgtactgttgtgcagattgtacactgcacaactccagagggcaccattcacattgccatctatgtgaatggtgccaaatggtccctcctggaggagacctgttgtatagttcacaatcctggcactatacagggcacaatctgtgcaaccacatgctgaggtcctgactgacaccctctgtgtgacttttctctgataaagacaccatccctctgctgcagctagggttgcttcatttgccaatctacagatcattcaggataatcttcatttcaaacatacattcacctactttctgtaagcactgtagtgtttgtcaagccaggtgtcctggtttcaagtttggaaaataggttgttggatatatcttttaagtgccattttgcctatattttgccatttcatttttttaattgaggaaaatgtagaaaacaaatataatctcgtggtttgctagaaaataaaaacatttaatatgttaattttttaaaggacatattttcattaaaatatagctctgtaagtgaaagtgagaagaaaataattttaggtgtacatagaatccatctccaaagtatctacacgtatagactagtaagttaagattaacccattggctctacagaaataaaagagagctaccatgcatccaagaaggccaacctgtctaatagagatagatctggatttttaattagtggaggaaccaactttgtatcacccaacaaggaaggtgatgaaaagattcggagacatttttatactatatttctcattgtttctagaatgaaatccatagtcttcaagctggaagtagctttttagttcactcattatttattcatttaattaattgttactatttgccaaacactgtgatcaagtgtctgggctccttcatgaggaatctgtggtcataaagttggttagagatagggccagaaacaaaccccagatgttctgtatccaggaccctttaccccacagggctgttaaatatctccatgtagttatattcaggtgattaaataggagagcatctgtgtattgcatgtgacctgcatgtaattcatgtaataaagatgaaatacaaaccctttgccagccatttctttattactctaaatgccacgacttaaggttcagcatcggggctaataatataagaattagtttggaaattctgcaaataaatattttcctgtctattcatactctttgattcaaatatttcaatcatgtcctttctcaaatgttgcctttacagattaaaatcctataaatagcactgacccctgaggaacatgatcttcttacccctatctttaagtattaatctagacagtttcctactgatgacaaaataaataccccagtctcatggtggctttctttttaaaggatttgttttgcaggggggtgggggggatatacagcacatagttcataacaatgtgaaattgcatttttggaagtatctatactcttcctttatacaattaaatctccctacttgctaaatattgctagacttggtggtttaggaggttgagtacatgtgagcaaaggggaacagctgttcttgccagatgccttcttcactgcacagacataaatactgcccaaggagcctctgcagggcagactgagatctagtttgaagtagctgcaaggagaccctttctgacatttttgcttggtaaattcattcacatgcaccttgaccaaaggatactaagctgagtgactaggacaagaattctgaatgcaaactactcaggttcaaatcctggctctgccatctaccttaccagctttttgacacttggcaagttacttaacctcactgtcttcagcctcctcatctgtaagtggggataatagtagtttcttcataggatcgaggattatatgaattagatattatcgttaataattccagcaacaaatacctgttaagctcctattccattccaattaccgtgaatgagggaaattgtcccccacttcatggaatttagagtatttttttcacactagaagccctgacccatctaagggttgggaagtcaatgcagtaaggtgtgaccagatttagttttacatgaattcgaatatgattttacaaaataagagttttatgaaactttctttcccttgcatatatttttatatgaatgtttggcctatgtcttgatataaaagtatttcttatgagtctagtgagaagattagcaattaaacagcaacctcaatacagtgcataagataaatgcagtgagtgtcacgggcacgtgcgaatgtcacccgacccagtaagggcaggtacagagaatcaggcaagccttccctgaggaagtaacatttaagctgagacttgaaggatgagtaaaaatttaccaaaagaagtggggtggaggaggagaaacagttcctttaagagcagtgagtagacctgggtgggtaggggagtagttaatgaagcaagggagaaacttgttcagatttgcattttagtaaggccactctggctgcatgaagagaatgggcaggaatcagttgggaaactttagtaatttcaggacacagcggcctagactggggtgggggcagtgtgtatttgagagggatcttgtacttacgtagaattgacaggacttgttgattgatggggaaaggtgctggagccagagcacaaaggtgcttatcccacacttctgatgtctaatttacaaaggtttcaagagacaaatctaagtctgaaagctccaagctcctaacttgaaaaaatgtccctgtaaacaggaagacagaatctttcaatcactttgcaaatcatctccctatcctgctggacatatctgcaggctgttgctgggcctaggagttggcagggcttcctgttccaaagtgggagggttcctggcaggagatggaaggctggaaacagaaaggaaactgggctagccaggcaccttgcatgaagagaaaagaagggaaacctggtactttcccatctgatccagaaattatctggtcggaaaataatttaaaagtacaggtaattcaaagatgtttatatttggctttgaaatgccatgcatttttggcactagacttactttgccaaacatttttcttaggccttattttgcattccctgaacatggaccatctgggcaacagggggatgagcccagagctcagagggagtctgggtgggtggctgaggaggtcctaatattcaaaacttggaatgaaaccacaactctctctcatcaccccaggtgatcagtacttatctgtctacctgtgtcctgccacagagcagggagctttttgtgatctaagccatgccatgtcatatggtgaactgaaaaacagctatctaattcccagcacaccaaatgtttcctacttacatcttcctactcacagggccacctccaccccgctggagtggcaggcagggctccacagcaatctcaaaatcaaaccgtatttggagcacaagacaggctgtttacagatgttaccataaaagacaatttaaataatcatcagtaccgttttacaaaacagctggccagaccggaaggccccttttccagttattcctaagattgctgcttccagaggagttgaaaggttagattaccttccctggctcaggtctacctagcacaggagagtcgtgcctcacagaaatcacttcaaaaaggatctcagcaccacatcccactagggcttagaagaatcctcagggtggcagccactccctacttaggaatcccatgcattcccctcttcttccatctggactgtgccacgccagggaattcatttggtccaggctagaattcactgggaacaattagcaacaggcccaaatctggaagttcagagaaattggttctctccgatttgttataaaattaagtaatatttttcacaatcaccacagagaaaagggcatttcctagtttcccagttcttacaggtcagaatggttggttcacaggaaatccttagtaggcgctctgtgatgcatctatgtttttccaagtgttggtatttttcatttaatagaaccttcttccaaaggagattagctgccagactcaggcagcccgtacgtttttgaaaacgccagcataggtttgactcaggtacctgaaatatctaaggaagcaaaggcagcggatgtgccaagggcaccctcacctgatatctacctcttcccctcctttaaggtccccttgattggaggtggcggaaagagtctctggtggctcgcccaaccctttagaacattcgcccctacccgcttcccctgtctccttgccaggcaggagtcctttctcgcacttaccctccattccccttacacacacctcgctgaggtcatcctcagcgtgcagcccggaggggaagggaaacgtgagctaaagcaacaggttccacccacagcctgaacttggaaggggatgcggcggcggcaaggcggctggagctgcgcggtggagggagaggaagcggcgaggaggaaggtggaagggaaatgatggtgcatgaccaccgagcacacgtcactcgggctcccacatgggcttgtgtatgtgcgtgtgtgaggggagggaggtccttcacagggtcactcgggcacttccgcgtggaataggaggcgccaggctcgtgctttgggatgccgggtggcttcggcggggtaacgagtcacgcagagacggcttgaggcaagccaagaaaatacgggtgtcggcgtgaaaatacaccactcttcccagcgcgccgcccttgctaactggctggacctgcgcccctaacgcccagtgcccccttcttttgggcctatcttggcccctccaaccccatcccagcctgcctcctgctccagcctgccgccgcgaaaaccgggactgcggactgcgccgcgcccggcagcctctgggcatgctcggtggcgggaccggctccaccgccaggagggcgcgtcctccctcccctagggcggtgacggcgcctgcagcgacttgccgccgcgccccggccaggcacaccttttggggaggcgggggaccaccctgcccggcgtgggccgagagcgccccccaccccgagccttccggcgggtgggaggaggggccggccagggagacgcggaggcgggagtgagacctccgactgccagcggttccttacaaagtaaagctcagctcgcgcgcggacccgggctcccagccgcgggcggggaaggggcggggcggggcggggccgggccgggccgggccggggcggggggtggtctcagcgcctagagcgagatgcgaaattagtagccgcccacccccttctcagttcccgcccccagggaattataatttcctgggaaagtgtctggttctcggagaatccttggggcggggtaaaggggcgcgcctggcgcaaaatggttaatacaaagtctgcgcgcgccgcggggccccttgtatgaaaagtgtgcgcgctggtggctgggcacccctttgctaatttgagggttagttaccggcaggaagtctggttgtgcgagaggaaaggcgggcaggagggaagcctcaggctggtgctggctcccgcccccaggcctccttgggggacgcacctctgacccagcgggcgcagggtgcggggcactgagccggggcatttggggcgggtggcgggaggctggagcaggcttggcccagcagctcactctctacctcctccccctaggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgtaagttggccggggtgcgtgcccacgcgcgcacacacgcgtacacaccccgcgcacagcccgcacgccccctccctgcgctcccgcccgcccgcggccccattcattcttcctcgagggtgggggccaggccagagagcctgccgtctgctcccctggggataaggttgctcggtctgtgagctgtctgggtttgcaggatgggcggagaggaaggaggagcagccagagggcagcggaaagtcgggttagtggaaccggcgactcattttaatggaattacttatggagaccaggttgtgagtcacttgcctgaaaataaatccggggagattctggcaccaaaagtcagtgcctgcgggggatatttcaaatcgtaatagttgtggctttgtcaatcgtggtggctctcctctcgttgccactaatgtctcatccatatataggcttgttcctatgcacacgcacacattcgcctgcccacaccaccggtctggcagcggggttcgttccgtcttgtgttaagcagatgctcctgtatttgaatgggttgattttcctcctctaagactttcttcctttatgaaacccgagttattgttgacctgggggaacggggtaaatggacctgtcaggataagggaggggttcttccctcggtcgcctgactcactccctctgctgtgaatccctccttgttttgataacggagccacttacagtttcttcccggaggctactgcctcaattcaggaaagccagacagggaggggtgctggagtggaaaagagggagggaggagaggagggctgcatctataataagaagcactggcaggttcacacttgtctcaacatcttttttgcccctgagagaagagcagataaatgacttaaaagaaaaccatcatgaaggtagctcccctgtttagcactgctttgagataaagcaacagttgtaatttgaaatcattaatgatgaccctaattagggctgaagggcgtagttgaaaggagctgctttctgtgtgtggcagctgtgtggcaggtgggaaaatgcttgccttgcgggtgtaatttttgcgacaccaggaccccggggctcctgaaaattgggtgcatgcacttctgacttcaggggtgaggatggtaactgtgtttcacagagaaattgccatggttctatcagagagcgcccttggctgacagagcctgctggttagtttcccttgggaaactacttaataaattagcatactcattttaattccagctgtttaggagtttaccatggccattaacagacgtggaatctttccattacagtcaatactatctcttataccttgcaatagaaaatatccttttcccactttgtgcttgagaaaaatacctcattaatacctgggcttgaacaatgagtgggaaataagcaggaggttagtttgctattgcgtgacatttatacattccaggaaaatttagtacttgggtatacatgcaaagttagggtttgatggtgacaatgagctccattattcaaaagttgtggaacaaattgtttttgagcacccatgtatgtgctgtgtgccagggatggttctgagtgctgtagttacacatcagtccacatggggctgaaattctggtgagggaagggtagggatacagactgccttccctccaggaacttaaaatttgatggcttacctagcaccacctcatacccccacccccaacgcatcttctggttattgtgaagactatgaatctttccttcttgggcagtctttgaaaccaatggtgtatcctcacctagtgaacagtttgcatatttgcatatttgggtttctttccttcacttccagctttcctggaaatgccccttctggtcatttcctctacaagttacacagagaaatttagatttcattgtgtcaaagcaaggatgtatacagaaaaaagggagaaggaggtagcatttgaggttaatggtggattttttcatgttttggtttgtgtttgaacaaaattactagtcagtgttggtttagaatactgtttttcaaacagtaagtttcccatgaaatcaccttagcatttaaaaaaatgaaataaaatagaatgtatgatagtgtattgcagggagtcatagtaaagttggtaatttttaaaactttagttttatatgtatggtgggttgcaacataaagtttacttctcactatgggtcgctgttataaaagattgaaaagcactgatttaaatcctgtttagtgctgcctggagtacgtaagggaatttatgaccatgaggacagaaaccggagaagaacaaaggagccgtgtggaagagaaggcctgccttgaaggaactgttcaaatccaatgatattttactcctctttaaaatgtcttgtatgaatatatttaagtggcattaatacacaccactaggaatggggtatacaatgaaaaggggatagcttctcttcaccaagtaagcctattcctacttcagggcttttgcccttctgtaacctctgcttggaagcaagtgtctggttccttctcatcattccagactcagttcaactctcaccagctcagagaagctgtcccccaccacccttcctaaagtaaagtaacagcactgcaccccaactccagcactcctggtgtattgttttcttagtgcttgtcactatctgacattatcttatttagtcctctatttttggtccctctgaaatgtaggcgggagttcttgcctgttttttaactctataacctattgcctggaacatgcctgggatggagtaggttctcaaatattgaatgaatgaatgaatgaatgtttatgacaacaacacaacccatacctaatccaactcccattttacagttgagaaaattgaagcccagagaggttaagtgatttgcctcagacccagtgagaaacttatgaacagggttttgttctttcttgtgacaccagactagttccccgcccccttttttaatgcttaaaataatttgaaataaaaggaaaggaaggagctcccacctccctgaaacttaaagggtttcctattgacaagtctcttattgcacttccttagaattaaggacataagtaaactgggaaatcatcaaaacccccttacttatgagtcttcttttgtagacagggttttgtattgttttgtttcaatgacatactattgggttctgcagagcagggtagtgacagaatccatgtctcctcactccacatccagtgctctttccttcctcttagttgtggtgatgcacgcagaaggatgactgaggtctcaaaaatgggatgacaatcagctatccctaattcagataagattgagaggcaaatttaaaaatgcacaatgtttaggtgggatttaaaacctagcactgaccttcactttgcgatgggtttagaaaactaatctctctcttggtatctgtggaggatgatgagcttggatgctgtcaggaactatctttggtgtcacagcatggaagggcctggggagtcctgatggaaacactctagtgactggatccttgctccatctcagagctgggggctcaagacagacctccagcacctggtccagccctccactgtgatgtcatcacctgggacagccatatccccagtagttcgcattgtgcctggcacaaataaatgcttgaaacatgcagagagggtgaggggctctacccaaaaaccagaactactcccagaagtgccccttccatgggcagcccctgctcatctggtgtcagtgtgcttctcacagtcctgccctgggcttgtattccgtcttgtgcgtgaacactcttaataaattcaagggccatagatggagtaaagaaaggttctggggttggtgcctttgatgtcagattaggagtcctgcttgcagaagttcatgtttctcttaaattcttatcttcttgcctactctaactctggtgcacaggactggacagttttccctcttatgagagcgggccacaaacagtcggctttctctcttctgcttctccaggaccttagtgcatcactgtagccctcttgctcctgttcaaaaggctctgtggacctgttgccaagtggggtgggagggggggcactgcctcagtgtactcttcctcctaaatggaatataattacacatctttttctctgtgtttgtccctgaggcttcctgtccttcatgggacgtgttcctccatgtctagcctgttccctgtctctggagactcagcctattttgacgcttttctttaaaaatagctttattggccaggcatggtggctcaggcctgtaatcccagcactttgggaggccaaggcaggcggatcacctgaggtcaggagttcgagaccagcctggccaacgtggtgaaaccccatctctactaaaaatacaaaaattagccgggcatggtggcgggcgcctgtaatcccagctactcgggaggctgaggcaggagaatcgcttaaacccaggaggcggaggttgcagtgagccaagatcacaccattgcactccagcctgggtgacaagagtgaagcttcgtctcaaaaattaaataaaataaaataaaaatagctttattaaggtataagtgacatacatcaactgtacatagttaaaatgtacaatttgatgagttttgacatatgtatggcatatgtatgtgttttgacacacctgtgaaaccatcatgaacatcaagataatgaacatatttagcatccccaaaagtatccttgcactcctttgtaataccaccatcttgtccctaggcaaccaactgatctgatttctatgttatagattagtttatgccttctaaaattaacataagtggaatcacagtatgtgtggatttttgtgtggcttctttaactcagaaagtgattattttgagattcatccatgttattgtatatatcagtggttcgtttgaactcttgctgagtagtgttccattttgtggatataccattttcatctgttgttatacatgtgcattgtttctaggttttggctattacaaataacattgttatggacacatgtatacactttatctatttatttttggggtgaagttttgctcttgtcacccaggctggagtgcaatgatgctatcttggctcactgccacctccgcctgctcagttcaagtgattctcctgcctcagcctcctgagtagctgggattacaggcagccaccatcatgcctggctaatttttgtatttttgtagagacggggtgtcaccatgttggtcaagctgatcttgaactcctgacctcaggtaatccgcccaccttcgcctcccaaagtgctgggattacaggtgtgagccactgtgccgggcctgaatatacactttcatttctcttgggtaaataactagaaataagaacggcttgatcacgtggtaggtgtatgtttacctgtgtaagaagctgcctgtcttccaaggaagtactattttactttgccatcacatgatgcttaaatcactgaaagaggtttccccttttcccattgctctattccatctgcatcctgctttccaggacacctcccttcaggtggctgggtggctgctccctccctcttaagagaaaacaacaagagagcaaggagatcacttgtcacatccaaccagtctttactcctgttgtttaaaaaaggaaaggaatcatttttaaattagagaagagctctagctgtagactcaacacattttaagtgcagttttattattttttagtgcctctgacaggtgcattttcctcatttaatgagaagataagaacaattttaattgacacgttaattgaaagcaaattcttctgacgaagttatttccaaagtacttgaaaataatgtgtctttttatttgtttatactattagctagtagcacactttttaaattacctacatttcttcctagaatggtactaattataggttattttcaatgtattattctgtaagaattacagcccagttacttcttccccatcaatgacacactactaaagtagcttgaatggctgagtagtttatttccttagttacttgggctatgtttaaattacacaagtgtctgtttttgtagactgaattaagatgtctttagtattcctacaaaatacagtaaagtttataagtttaataagttgtgtgattctgcagcctggggcacagcattgaaaacattctgtgtggaatgcagctatcacttattcctgttagttagagagcatgacatgacagtgttaaaatttttttttctttttactgtaactggaaattaccagggtgaaatgtattctgtgtttcaaccttttaccttgaaatatctagtactataatgaaaagttctttgcctactttcctatttatgatgatttttgcttaagagctgcaaaggctgctctgtctactggcatgtactctagacttcaaagaaatatggttaggtttttgtctttgttgtttttttttttttttaaattaggttgcaggcaaaccacatgtaaacaattcttaaaattttgaaaatataccattagttctggggctatctatgtgtatatacaattaagttattattggatggagcattgtattttagaacagtctttgaaaatgtagtttgattaaaataaatctttgcctaccaattagtttgtacatagtggaccttcaagacatcctcaggaaaattttcaggatgcacatctaaaaaacagaggcagatatcctcatcacacttgaagagcttcttgaacaactcaccactggcatcacctcacctccctccatcccttcctgctctgcctgcatttccagttccagactccttgctggcattcctgacagaaatcttacacctgacaaaaatcaggccagactcatcaatttctgattttggttcccggctcttttggtgacatcataactacttttttttcagacagtctcgctctgtcgcccaggctgcagtacagtggcacaatctcgactcgctgcaacccccatctcccagtttcaagcaattctcatgcctcagcctccggagtagctggtagtactacaggtgcccaccaccatgcccaactaactttttagggatggggtttctccatgttggccagactggtctcgaactcctgacctcaagtgatccacccgccttggcctcccaagtgctgggattataggcgtgagccaccacgcccggcccataactacttttatcttgaattctctcttgtcttcttatgggtatgtctcttaacagtccaactatcttaagtcctccctcccccttaaacacatattacacattccctgaagtgtagacattttatatacagttgttatctggttggttaatgtattttgtgccagcctttctctttagttctttaatttactcaaagttgctacactataaactttcttattagtgctaaagtagtaattccaggtcctttcttaaaagcttatccaaatgctgtgatgttgcatttgcattttatttatttatttattttttgagacggaatcttgctctgtcgcctaggctggagtacagtggcgcaatctcagctcactgcaaactccgcctcccgggttcaagtgattctcctgcctcagcctcctgagtagctgggactacaggtgccagccaccatgcccggctaatttttgtatttttactagagacgggatttcactatgttggccaggctagtctcgaactcctgacctcaagtgatccgcctgcctcagcctcccaaagtgctgggattacaggcatgagccactgcgcccggcctacatttgcactttaaaatagaaatttgtttttatttctggacctctgtcgctgaagagatgaatggtcttgttttcttacttttgaaaatcggtccttagtgttttaatgaaaagggcgtttgcgggtgcttttccttagttgcttgatgctccctgtgctctcagcacaaatgcactttctactgtcacagggagactattttgcactaaacctttgtagaaattcaagtgtcaattgtgaaattgagcattttcaatagaagggtaataggattttagagatagacagggattctgggagatcatctcatcaaatgctattttcaaaggaggaaactaaggtctgtgaagattacacatcttcacctaacttcctcagcccaagcctgacccagcctcaagtcacccgactcctaattcccacttttaatgacctgtgcccccacttcagtgcttcaacagatgccacctttttaaattgttttttttttcttttaaaaatgaatgggtgttccccaaatttaatttggagtacagatccagtttcataatttaagagcttccaaaactggaagtagattctaatttttatcatttgatagaaaagatttcattttgttgatttttttctttttttaaacctatgttgtcagaacaattataaaattgctttcttccttttaaacttcagctcatcactgtgtatatttctagcaacagaacagtgctctccctggatgatagaaagctagcggagagaagatctctgtgtggctcaccccacaagtgaagacagattttgttctatctaaagagtaccctccaaaaggagaaataacaaaaccaagaaaaggctagtaggaaagtatttgtggggttcagaagcagcccataaaatagtctagattaagatgcctggcgtagttagaatatgtgtgagaacttcttattccgacttgtatgccacttacttgtacttagaatttaaaaggcttgctgatttgtagtgtttttgagtgttccctggtgagagcaagaaatagaaaaatgaatataaggacagggaaatacatttggatttttatttgtgtatttccccagttaaatttgtagggctgaactgtccttaattatttgtttcatatccaggatagttgtaataataatcattctccttcacttaccaagtctctcttaaaatctgcaagagctctccttgtttctcagatggtcttgcttctttttgttgtctgtgtgtttgttttgtcttagttttggctactacttcccttttgtgaataattatcttcctgtcttctgaaaatggaagataaaaaaataataaaataaaaagtaattgttgccctttatatatatctgttaaataattatgtcaagcatgttctccactgatccttatcacttgtctttatctgttctcatttatgcatatacttaatctaattttttctctccactgaccgatttttcaatatttgcatcattttatgttattttcatttttttcctactcttggggtatatttcccgtaaagtgtaggtagttcaaaagatgatgtttaggctaggaaaagcccaggtggtaggaatgatcccaaccagtgttttgttcagccccaggttgatagttttttaaaaggtacttgtaaacccatttttttgcttcctctaaccaatatgaggttgtattaaagccaaacttactgaaagctaaagttaccaactttcttagtctgactttgtgtatcagattttccaattattgccacttgtatctgtacattttactgatgcctctgtatctccacccaaacatttcatatgtatgtgtaatcaaataacctctttggcttatccatcatcagcaatatcacattaatcattttttttcttttttttcttccatttctcagagtctcttcttagtatttatggttcatgaaagtgactgtgcatctttcttccttgggatattagcatagtagacccaaacaaaaagcttcaatttttatggattccaagaagcagtgcattagtctgcagctgatttctgcaaattcatcaattcaagagggttttattgcccatgtctgagatgattgatcccttcaaaactctgccgtatagaaataaatgtcttagttattcacagagttagttttttgtttttgttttacaaagtattacaaaaagcttctatcaggaaagtgtgtggggttgggcttttccaggtgcagaggcaggtgattctccatttgccacaggttgctggagctgcttttcaggatgcttgggaaagggcagaaaccctctgcagcctcccagccaggcctgcagacagcggatggtctgtctgtgcctccctgggcataccccagctgattgggtcatgctgttgcccctcagcagcacacaccccttgcttcctcctctgagatctccccactgtggtcctcagcctgcctgtttcgcctttctctcctgtgcaggttaccaattcaaagtccctaagaaagtggctcatctagcacagggtgcctctggtggccaggaccccctgccaggcccactcttgtactgtttgttgttggagagatgagggcaggcactccctagccacccagctgtgccagtgttggcctgctcacacgtgggttgtaggcgtgcctggaacaaaacaattggtaagtcctggcagctcctaaatgaatgtaactggattctgcttccttcttggtttgccatatatggagagaactttgctttctgaaaaattttaaagggaatgaggtaatttcctcataattcctaagatctccggcagtgttgtaaatttagatttgaggttagagtactaaaaaataaaaacaaaagcagaaaagctgctgtgctctgaaatgccagggtgtttttaatgtcaagtccagcagcataatagcttttacctcttttccccacctaaagaaagagtagtgttaaacttatttccaaaataaaaggagtctgaacctctaggaaactggtacagtatcatcttagaaaagaacctaaatgctaatctacactcataaaaataacatgttttcaaatagtttcagaaccaattcagtctcctgtttttctcttcatgataccagtagctaaaaattaccctacttaatgaaaattgcagacaattttttttctttatgcagtcttacataatttttggtccattttgacctagtctgacattttattttgaacaactacatcttaagtgttctgtcttttttttttttttttttttttggaagatttattgtgaagagcgaaagaacaaagcttcaacagtgtggaaggggacctgaatgggttgcccagtgctctgtcctttttgtttccactctaaaattggttcggcaaggagtaagagagtagaccactggcattttatttttgaacactcgaattgtataaccagtaatctgttagagttgttatccatcttacagtgaccccatcatctgacccaaatagcgtttaaaataagagctcgttctagaagaacaactttaggcagcagtaactttaaaacattttgaatacctgctctactgtggtatagtgatctaaatattagatttatttttcttgtgtctcatatagaaactctaaacaaagcagatgaacagttgtgtctgtactaacacgtgactaaaacctctatagagttccagtgtgctgaaagccaaattaaagttctctttttttagtaaacaatcacactgggaatgagaatattagagctaagagggaggccagagcaagggtggtaaacgcggatgcttccagaggtcacatagataacccactggagcagtgggcccagtgggagaggaccatggtgtcctggaaggtatgtcccaggggtaaaggggcagctgctgtcacttgccgcctgacttcgtgccatgccagaacatgatgtcagtgttctgatgtgtcaggagaagcccaagatccaagcctgagatgttatgagaactatcttgactattacatattggcaaacaactttaaacatacatatacatttgtgagactaacaaatatctgctgtccagaatactgcccctaggctaccagttacccatcttgctcctaatccaacctcctcacttttcatatgagaaaactgagatccaaagaggctaaatgtcttacctgaaatgaggataagttggggcaaggtgggaccatttgccaagaggtctggtgagattgtagaagtaagaaatcttaaggaggaaaacccatgaaggagtgttgctcttatttattgacaccagagtagctttttttttctcctttcaatgcttaaaataatgagaaataataacatccaaaggaaaaaaacaagacccactacacacctctatttcacttaatttttatacacatcccattacttagcatttacttttctctttcatcttcaaagcagttcaaaaattgatttgttatttgtagtcagggaactgtgtcatgatttattttttattatttattaataataaaaagggaagaactccttaagaacagagtatctgaaatataaacacacacacatatgtggcctcagctgtttcatctgctagaaattcatctgagaccacttaattccaaggtgtggtggtgagtctttataaaacttcttgttatacagaatctaatgaaacttcaatattgctcagtcatattgagactttatttaattttagctgtcgtacataatacagtggaggacctgttgaaaatataaaggttgggactcttttttcctctttggaactattggctctaagtacaaagttaacatagattccaaataaactaaacaattttaggaggtttattcacttttatttagaaaaacaggaaacatttttttttttttgagatagagtctcgctctgtcacccaggctggagtgcagtggcgtgatcttggctcactgcacccgcctcccgggttcaggccactctcctaactcagcctcctgagtagctgggactacaggcgcccgccagcgcgcctgccagcacgcccagctaattttttgtatttttagtagagacggggtttcaccatgttagccaggatggtctctatctcctgacctcatgatccacctgcctcggcctcccaaagtgctgggattacaggcgtgagccaccgcgcccggctaggaaacattttttatattagtttttttttaaaaaacttattttggaataattttagatttgcaaataaattacaaagatagtacacagagttctcaaatatccttcagcagcttccccttatgttaatatcttatatgtctaggatacatttttcaagctattcatttttcaagaaatgaacatttacccaatactatcacctaacctacaaactttattgagatttatattggcctttgaaattaaaaagggtatactaaaactattcgacaactgtaataagtaatatatcctcacaggctgtgacttgaggagggaggggagagttaggttcctccacattctacactgcccctccataaagccatcccaaacaggcatgaaatttaagtaaacatggtgctaatatatttgctatgtaaatgcttttgaagacaagtctctagcctcctcttccaatcaggttgccttgcctctatccctcctcggtggaactctggtgctgtctctggagaagacagatggagtgaaggggcagataaagagagaaatatgtgcacacacggcctgtggagggtgaatctccagtgagggggctgttttgtgagttcttaagtgtagaaataaacttgcccacagtctgctttccatctgggctgtggacagccacaagttctcacttgttatttgctctctgatatccagattttttattgttttaaagtaggaaacaacttttcagcttggtagtttacttctttaaagttaagtttctggtggaattgtgaaggctctatgaatgtccagtggaagtcctgggagagggtacattataggcaactcacagaggtgtaagcaacctgtggaacaaatgccactcaggatgtgaaaggactggggttaagtcatgaggaacagattagaaatggcatagaaaagggtttgggactcttgcaggagtggaaaagggaagggagattggcacatcaggatgttcaatatttgttgactgattgaatggtcagaatttcaaaaactaaaccactaatgggcaccaggcatagttttgttgccaatagaaggatgtccccggccaggtgcagtggctcacgcctgtaatcccagcactttgggaggcctgagtgggcagatcaccttgaggtcaggagttggagaccagcctggccaacatggtgaaaccctgtctctaccaaaaaaaaaaaaaaaagttagctggtcatggtggcacacacctgtaatcccagctatttgagaggctaaggcaggagaatcacttgaactcaggaggcagaggttgcagtgagccaagatcgcaccatggcactgcagtccatgagactccatggactccatctcaaaaaaaaaagaaggatgtccccatgactcagtgaattctcatagagcatctggttttgccaacaggatcggtaatttccttttgtttaatttttttttaactaattatgtgttcaatatattgtggattgtgatagcactaactcaacatttctttcaggaaaattgtgttttctggaccacagtaatttgaatagctccttcaacttagatattctcttgaagttcattacatgctgtgctggaggatgggacatattggaaataccctcctctatattcttaggttcttcctcctatgatggatgttcatgggttttggtacccagcatgagttacccttcctaagagctcccagcttccgtttgggggactacctcttccgcgtcatgtgtgattttggtggaagagtaattacaagtagctgactcatgttctgggaacttcagctccagttccttctcctcccctggctctgctgcaggtagaagagctcccgggaaatttatgtctagagcatttgcagcaaggtcctcagggacagtcggaggccctcgcagtgttgactgctgccaaacccatgctatgaagggaccatggctgtgacttctgcttcctgaccttgtttctacttgtttccaaagtgctgctccagtgtctgcctcctgttgattctgtgggtttgttagccagcattggttttaattgcttgcaagtcgggaaccctaattaataacagtgggcagtctcttgacttaggactcaagttcaaaccatgacagttgaagacccagtattaataaatacatttctcttgcccaatcattaaatatcgaaggtgtaatggaccttaaagctcatctggcccaaacccctatactttcctccagtggtgaggaaataaacacaccaagtgaaagagatgttcaaagtgtcataaatgtaacatgccaagttggcatcctacatagagacatcagggttcattcgtctcggcatcttgtccacacaccctcaccgtactcctttacctctgtgacccatagtgtccacttaatgggatgggatgacagggcagaacctagggtggcaccagtgaccttggaaagggtcacagctaactagcccccatagggattcgacctgtgactctggtggtgttaataccaagattcagacactgagctgaaatgtcagcgtctagctgcatccacaggtgtgcctgtgtgctctgatgccagctcagatgcgtccacttgatgaggctgagactgtgcatgaggaggtggttatcagcagctccaggaatcagatcatcatctccttatgattattgggataaaaacaactagttttacagcataaattttatatttttaatgtgaattaaagattgctttctaaccattccttatcttatagaaactgtttttgtgagttctaagtgtagcatgtctctgagttctgtgggggtaaatgttctgaatccattttggagcaagagttatttatttatttattgagacagagttttgctcttgttgcccaggctggagtgcaatggcatgatctcggctcactgcaacctccacctcttaggttcaagcgattcacctgcctcggcctctcaagtagctgggattacaggtgcacaccaccacgcccagctagtttttgtatttttagtagagatggggtttcactatgttggccaggctggtctcgaactcctgatctcaggtgatccatacaccttggcctcctaaagtgctgggattataggtgtgagccaccatgcccagccaataagttatatttttaaattgcttatgtgaagcttttcagcaaagcatagcacacaaaatgatgtctgccaagaattttcttaatatatgccattattttttcttcataactttactcaatgagtgaatattgattgaatgcccactatgtgttaggtatggagtacagagaggagtggaagttgacagggagctgtcatgtcatggagcttgtggtcacacagggaagagtgacagaaatcacatcaacacacatgggtgcatcccaggagggtgacaatggtgcaagaagtggacagacacacactaaacctgacctaaggagtcacttgtcatcccttcccaggacagggcttctctgtggcacaggaccagtagccttcatacccttgccactaaaaatctagaaaacagccagaaattattttaaaaagcaagcatgttcacattgtgtggtaattaataataatagctattatgtattgaatttatatgtagaataggactgtggttctctgaggttacgggcagtcttgctgtgatgggcatgacttgggagcccttgccaccaggtggcaacacacctggagagctctcctccctgaagtcctgaaatcacatccagcaatagcttcatctgcggcagcatgtccagcaaagagactctcactgaaagaccaaaaagggagacaaggttgggtaggaggaagctgagggtgctcaagctatggcagagtgctgggccacctacttttcattagatgcccatactggggcaggtgaatactattcatcccattttatagacagggaaactgaagcttatggtggaatcacagagagagtgcgtgtgctttccactttcagttataaactactataccaaatagctggaagttagcctctgtaaccttcattacacaataacacaatagctgtttctctttgctaatagctagagccacatctgaatatctgttatctcttggtatgtaataccctcttatgtctatgtacttctatataagattttttcataaatggaaacttttttttaatttgcaaaaaaaatcattcaaacataaatgcatggctttatgcctttctttctgccttgaatgttcccaccaccactctgtgcttacttgtaattatcaaatccatgcaatcttaagtctcagttagaaactcattctatatattggctggaagtgattgtaatgatcctcaggtttagcagaggctctgagaggttaaaggatgattcaatgtgcgctgctctcttgacatctgatatcaagctagctgctccttgtaaattgatttatatgtagaatatgactatagatccctaaggttacaggcagccttgctgtgatgggcatgacttgggagcccttgccacctcaacacacccagagagctctcctcccagaagtcctgaaatcacatctagcgatagcttcatctgcggcagcatgtccagcaaagagactgtcaccgaaggaccaggaagggagacaaggttgggaagggggaagttgagggtacacaagctacagggaaatccactaccttctgcaatgtttttacccattcatttacttattcacttaatagtcatttatttgctcagtagctgcactctgctagatacttgggagtcaacctagctaggattttttcccaagtggtctatttattttgttgagggagaggcacatcaaacaaacaccaaggttggttatttaacatccaagataagtgattcagttgactttggagactgacttggccagctgccgaggcagagacagtgctgagggattgacagctgaatggagacctgaagagcttctgggagccaggtgaaagggatggcaagagctgcccagccccaggcaagagggagtttggaaagtttcatggaaactgcaccaggagcatcctcaccaaaatcactcccttacctcacaaacacatcccaggcatctgagtctgcacttcatttgtggaactttccaccagtcctaaaagccatcttgcgcacaataaaataatcttgcaattttcctgtagttgatttgaaatatttttatgctgcaaggagtttaataacaggcacaatgcttgaaatgtcacttcttatacttggagaactggagtggagtggagaatggagccttttagggaagtacgtgggaagaagctgtttaaatccagtaatgaattagtgttaaacttctaaggctccaggaacttcttgagtattttggtttaaagtagttggcatatttgagggtttttctcccaggtctactggaagctgtgagctgggaatatagtaaaacagaggtcccagcctttttcctgatgagttatttgtgatttacctgaagctttaggcgcactaacccaagatgaagtaaaggcgttgtaatgccaggtgccaacagaaagtcaggtattctcatgccagccacatgagcactccaccccggggcttctttctaaaacccttctgtgctttgcaggcaggtccaaggaggttagagaaacccctgcagtcccccttccatcccatatgtgatgattggattggggagtcttggttaggagcaaaggataattaccgtgtcagagcacgaccaatgaattgtaacaagctgaggtaaagtttaatttcctcttccacctaccgcaatgaaaagctgttgaatgtcaaatatggtttgcacctttgaagtgaaaatgttttctgccacatgtcatcccgttgagcaagtctacacctgttcatctggtcatgggttagcagaaagaatgaaagagagaaactctgtgcctttgagcgaagacatttttcagtacttattactctgtttcactttccagctttcaccttctctgcagtttttctttcatcttgacactataaggaatgcatgagccttccctatggaacattgtagatcttgtttaaatggtaaaaacatctccagctcagctgaccagttcattagaatagctatgtgctacacaagaaacatgaaatattttgtcaggtaggaatctaaggaatcctggtgacgtgggctttcccgtcagtcgtttgctcttttcccttaacttaagccttgtgctgctttagttatcctgtagaataaatggaaaagtaaatggttttattttattttggagacggagtcttgtgacgcccaggctggagtgcagtggtgccatctcagctcactgcaacctctgcctcccaggttcaagcaattctcctgccccagcctcctgagtagctgagactacagacgcgtgccaccatgcccagctgatttttgtatttttagtagagacagggtttcaccatattggccaggctggtctcgagctcctgacctcaagtgatccacctgcctctgcccccaaagtgctaggattataggcgtgagccactgcgcctggcccaagtaaatggttttaaatcacggtgctaggtctgaggaaattatttacaaagctctatcaaaaaacaaaactgtggaatcttttaaattaagtaacagtcaaaaagccaatgtgaatttttttccttggtatggctgctttgcttcatagctcagagactgaaccagagctagaggttatgaactagacgaggatttcatacatttttttctccagccacttttctccgttagtaaataaacaaatgaataaaataaaaaggttgcagggtgaacccaaaattctgtaatactgttaaaaaatcatgattaagtattattcattttatacacctaccaatggcaatgcacttaaaatgccatatcagaacagttgtgcaacatctcaatttgatagtttttctaagaagcataaccaagcttccataaatgtagtgaaagcttttttcatattaaagacatgttatcgggagatggaatgtttccttcttcctacataactgaacagtgattaaatattgactaagagccaggagttgacagccattggcctcaccctggtaaatgctgatatatgatgctgaatgtaaatacagagccatcctctcagggccatagttttgttggttttttttttttttttctgttgggagatggggagccagcaagttgtagcttatgcttgaggtgtcagattcaagtgttgcaatagaagtgtgtaatttgaaacaagtaattctttaaaaagccacccaactgtcaaaagaaaaatatatttttctaatcaatctgaataataaacagaatgctagttagaagttttagcaaaacatccagggtacccactgaatgctgctgtttgtagaaacaaaagagctatccatcactggggcagcttatactttcatagacaacgattgtttggtttatatgaaacaaactggtcgaaacatcagatttattttggggacatgaatatatgtttgggaaattttaaaacatcttatttttgttgtatgtgtattttcttttttgttgttttaaacatctatttaaaatatgcagttgatattttccctccctctatggggaaaatcaaagataataatttttattacatttctttctgttaataaggttcattataagatcttattatttttatcccaagatttttaaaccctgcaggaaatacctggaagacttactcaacagctgtttgtagtgccatgaagcaaaatctgttaattctttattggttagaatgatttaaacataggtctccttttcagcaaatatagcaatctaaaaagtctgcttttttttccagcaagttttaatagacatttcctaacctctaaatcatctatgatacccttattgtgatggtcatctggacatcaacattgctatcttcaaagtataatgaaattaaaagatacttttaaagattattatagttctcaaattattcaaattgagccaaaatggattcatatggatttgagttgttattaattcctattagaggtattggcatatgtctgttcaaaaacattaatgcttcttaaatatcaatgactattcttccttgaaatgtactgagaaatggatttcgtgctgctgaaactgaaatgagaaggaatggtcataaatcatagtttagtttcgcacctttagtcagataagcagtgaagtgactctgagtcaaagcgtgtgtgtgtgtgtgtgtgtgtgtgtgtgtctgcgcgtgtgcactgtgtgtgtgtgtgtgtgtgttttgtggtgtgattgtggtctgtgtgtagtggagggatggttaatagaaatgaagcatcacagctggaccagccacagcacgtagaatccttccctggggcctcagtttacaagacaaataatttagagtaaccccttccccctttaaaaagccgaatatttttgtaaaaattaaagtgagcactgaagacagttttgaagacaaagaagaactcacagtaagcgagtctgagtaggtgcgtgactggccagctttggtattgactggcaaggagaagacttgttgagggttgactttgggtctgattagataccagggatttgacctatgtaatcttatttttgtcctctcaacaaactttgtacccctttttagtaaaaagatgagaacattaaaacctaggaagatttagtaacttccacatagctggtaagtggttgagttagaattccaactcccaggtgacttaatttaaaattgacttcaaagtagctcccatatggactgaatataggatacgagcctctgcctagccttcagtcctttttgtttggtttaggtgttggttgtctttgtaaacactggaagctgctgagtcatctccctcggctttttccatcacactttaccccacatacattcatacacacttggctcaagcttttcggttctttctctggacactagatgactgtcagccttacctgggccctgccccagaggctgccccagcatctggtaggagcttagtgagcggaatggattcctagtgaaataatgaatgtctttccttgtattctgtgtttgaaacctccaggatagcaattccatctgctatatgaaataagaaaaagtaaatattctttggttaacctttgtcattcgcctacttaaacctcaatcacatttctttgaaatcatgccagatttgtggagagcaaattgccaggtaaatggagggcaaattcaccaaactaattcttagttttttccttctctaagggaaggaacactttgcagcttaacagcattttcaaagtttcaaacaggactggctactgagttgaagaagcattagttggcccttaagtcctcccctctggccactgttgtccacttcacacatttggaccaacttccctcatctgagcctgaatcctattagccagcactgaaaatctggcatggtttcaaagaaatgtgattgaggtttatgtaggggaatgatgaaggttaaccaaggaatgtttactttttctgatttcatatagcagatggaattgctatcctagaggtttcaaaataatcttatcgagatgacttttgacccgtcttcaatagcattacaacaatccccgcagcctggagactaagctctgctgctgttttgagtgagctggccccacagagggtgtgacgtgggagtagagatgagtgtcggcctcaaagtctgctcccatctctcaggaaagcaccttctttagattaaggtattggggctgacactaaaatagatgatatttgaggctaagttttcaatttcactctttccagaaaaacaaagtactgatagggatctactctaaaagctggttttaaatacaaggcgttacagaagtgccaaatgcagtcactgcacttaaaatcatggcctgtggatagaaacaaagctgaagagtggcctgccgagtgtagagcgttctttcacttgtaagaaattaaatacagagacactcaacacaattcctggatgtgatttcctgttggttcatctacacactctagaagattcctgaggagaggtttattgcccaaaggaattcagtggaggtattttcaggtttggctgatttccaagagccccctctcagggccaaattatccaattccctttcttggtgagttcaccacacttcattcattcaccaaaaatatgcatggagagcctaactactacatactaggcactgagcatacagtgctaaaaataaaaaaagataaaatcctagtcctaatgtaggatacatgcattaaacatatgaacatatgaaccctgtatttgtcagggttcttcagagaaacataaccaatagggtataatatatatataattcaccttacatatatataaaattgagcatctgtaattaaaaaatctgaaatctaaaatgctccaaaattctaaactttttgagggctgacatgatgcttataggaaatgctgtggaatatttcagattttcagattagggatgcctcaccagtaagcataatgcaaatattccaaaatccaacaaaatccaacatttgagacacttctagtcccaagcatttcagataagagatactcaacctgtatatgtgtatgtatacaggttgtgtgtgtgtatctatatatacagagagagagagagagattgattttaaagaactggttcatgcagtttcgagggctggcaagtccaggccagcaggctggaaattccttcaaaagttaatgttgcaatcttgagtctaaaggctgtctggaggcagaatttcgtccttttcaggggacctctcttttctcttaatgtcatcaactgattggatgagaccggcccactttatggagagtaatctgttttacttagaattgactgatttaaatgttaatcacatcgaaagcacaccttcacagcaacatctcacctggcattgacaaacaactgtgcaccatggcctagccaagttgacacaaaattaaccataatcccccacctccaaataactgtcatttcaatttagtggctctcaaacttgagcaggaatcagaatcccctggaacacttgtttgaaacacaattgctgggctccacactcctgattcaggaggtctagggttgggccccaaaatttgtatttcaaacaagtcccgggtaacgctgattctgctggtccagggatcatactttgagaatgataagattacataattcagggtctgacccttagcctcgtggcccagaaactgattttgttatcataagaaagataattttatttatcagggatgtacccagtaaaccatgattccaaacctgatgtgtaaaatagcaatgccaatttattgatttatgataagcactaaaactacggtggtgagcagaacaatcctgtcagcctgggaggggcagtccatcctgtgggcagctccactgaaaggtgagcagtcagtaattggaaggaactggggatcccagccaatgatccaaaacaggtgatttaattgctgcaaccgctcccaccgccagaagggtcatattctcagttcctgcccaaggcccccctctacctggactttatacttggattaagacaggggcaactttggaggaatggatgttttcagttgaaagctttggtatttactgggctgaaagagtgctcctctctgctcctcagactctactcagcagctgggctcaaagttcatagaaattggaaatgcttttagtgaatcattaaaatgttaccttttacagaaactttttattggatataacttatactgtttttatgaaagaggaacttgagcagcattagaatgtgttaatgtatgtccttcatatgctcggtttcctttcttggtaataatttgagtgaagttacaatctttctgtaaaagactatttccagctgggtgcagtggctcacgcctgtaatcccagcgctttgaaaggcgggcggatcacttgaggtcaggagttccagaacagcctggccaatatggtgaaaccccatctctactaaaaatacaaaaatttagctggccatggtggtatgtacctgtagtcccagcgacttgggaggctggggcaggagaaacacttgaacccaggaggtggaggttgcagtgagccgagattgagcccctgcactccagcctgggtgacagagcgagattgtctcaaaaagaaaacaaaaaggctatttccatctttctctgcacattgagaggacctgactttgaaaaaatacttatacatttcatattttcaaaatttttcatgtccacttagaagcatttttttcccctaagctttggctttctgcctttatcattgctattttaagatttttacatgaaaaatgggatttgtttcttaatcctttaaaccaaattgtgttgtgaaaaagttgtgtttatgttatttattttaatattctttttttagaatcctgcaattatcctcagcatggaaagtttggccctaaaaccgcttctgagaaatcagaatgtggcctgagtctgggcggacccctcacaccttgcctgccttggacttcttatgaaacacaattgaatagataacctaaggcaaggggataaggtggccctggaacttcctcaaaggaatagggacctcagcgcagataagtagattcaaccactcagtgcagggaggtgcagtctcacgtttaacctctcagtttcattgtcatatcagcccaggggcccatcagcaaatagaaaccattctaagaatttcagggagcagatttaatgcaaggaatcagttaaacaagtgaaaaaaaacacagaaagagcaaaatgtggaaaccaaggtaacacagagactagtaacggcaagaagcagccaccactcctgggaccaagacaacaaaagggaagaggcgatgttaccagaaccttcccggcaggtgcctgctgtggctcaggcatagccctcagggaggggagacagagtcctgcttggggcatctggcaacctcagtcaagtcacagcaggggtgcccaagggccagctttctgcagctgctggaggggtgtcctacaggagttgggccctcctcttgctggccattcccccatgcctcccattggcaagatctagcagggagccaggtgagaaaggagcctgggaaacatccttcacacagtcttagcatcagagcagaagcccgtggcttcctttgctttccctcttccttgttggcctttattatcagttgtattcacttatctgactataaaacagggtaatattagtgagagaggaatctgttactgataaagaacaaggaaaggaatccattaatcccttttgattatcatacagattattccccagtgattattagaaaatacttttatcttaatgaggaaaaatctcaatttatttttaaaatcctggaaaatggaatgccgggtaatattcttatttaacttttgacattttttaaaaagtcatgttctatttggggtatgaacgtgtgtgcccataataattattttcatctgtgtgtgtctatcttgggcctagaaaaaaaatgactcattttcttctaaagattagaattccatgggcatctctttttggtacaattcctttgtttgttcattcctggagataatggagttggtactgatagtgccctccttgtattgtattcagctcagttcaatgagtctttattagggggcctgtcaagtgccaggctgtgcctcaaaggtatggaggcagaggagactcaggcggtgtggaagagcatggcttggggcataggacagacttggctttgaattccagttctaccgcctaagagtctcaccctgtggagctcagttgcttcatcctggatgtgaggatgaacactggtactgcaaggctgttaaagaattgtatgtggtaaagcacttgacaattgtctggaacataataaaggcttcataaatggtaacatgttgttattattttgataatcatctatggtttgggtacagactttttagtcattgtaaaatttaatagtagagtttttgtttgcttagatatctgtatttcattcacacaattagttggcattttagttgtttattagtttttagtcattggcctagaaggaaatggctacagttcccttgctcatctctagtaaggatttgaagtggctggattgtcatttataaggttttaacaagagaatttttaaaaattcaaatgctttaaccatttttcaggcctttggttttcatatttacttacaagttgatagtttgtttattggaatggagattttatttggggttgggtgtagagatgtgttctgttctagtggctagagtactgaattaaaattttagaaagaatttggatgtaatttttaactgaatcaggaatttgttcatagccttaagcaacctgttttattctctctgcttgttttcattgtgtgtttgccatctccttgactcacaatggtcttataagagttaatgaaaatgtttgcaaccagtgtatttttatcttggatgacaagagctgtgtacaaactgtaacttaccctacttttgttaatatgcgacaggattcttagccctcgccatgtatcataatccttgagtgcgtttaacatgttcagacccaagaaatcgcatcccccaccataagattctgatttatttaggaccctagcattagtgtgtgtactcttgtgtgtgcactgtctctgtctctctctgtctctctgtctctctcagcttcctaggtagttttaacatgcaatcaggattgaaaaccactggcgtaaaggataaagccaatctttgtgcttggttctttctcttatattgtgtctgttggccattttcttgcctattggatataggcagatgtattagctatatattgtcccattaacaaattaccacaaacttggcgggttaaaacaatacatatttattattttatacttctgaaggccagaagtctgaaatggtcttacagggctaaaatcaggttgttggcaaggctgattccttctggaggctctaggggagagtctgagtctcactctgtcgcccaggcttgagtgcagtggtgtcatctcgtctcactgcaacttctgcctcccgggttcaagtgattctcgtgcctcagcctcccaagtagctgggattacaggcgtgtgccaccaagcctggctaatttttgtatttttactagagatggggtttcaccatgttgcccaggctggtctcaaactcctggcctcaagtcatccacttgcctcagtatctcaaagttctgggattacaagcgtgagccactgtgcccgacctgttttcttgccttttccaatttctggaggctgcttgcattgcttgggtcatggccccacttcactctgacttctgcttctgtcatcctgtttcctctatgactctccttcctctctcttatgaggacccatgtaactacattcggcccacccgggtaattcaggatagtctccccatagcaaggtctttaacgtcatcacatctatggagtcccttttgccatgtgaagtagcatattcacaggttctggggatcagaacataaacatatgggaggatggggggtcattattctgcctaccagagcaagaataaaattcaaatccatactttttctcatttgagtacagaaacctctgagtcagccacagcttccctcctctacagtttctgatgggtaagagaggaagattttgtaaagtctcttaagtgataataccatgttcagaattttaattttatgatttctttaaaaggctgccaatttttagattttcaggtgctttaatagcttgtttcagaagtggattgcataacagttgggtctcattgtgctgaaatggtgcattgctgaagtctccctcaggtagagaacttttctgctactaatgcagtgattctcaacagggagtaggtgtggcttattcttgaattttttcttccagcaagaattttgtgtgttagacccccctacatacaaaaagactagattccggacctcaaggtcaaggccaaagaactcacctctagtggtcagtatacttgtatttcaacataattggttttctttgtaatcctgttttttactatatgcatgtaagatatcattctgagaaggggtccacaggcttccccagagtgccaaaggggccctccatggcacaaaaatgattaggagctcctaggagaggccaaaaaatagtattgtaataaaatggtaggtctcaccacaaagatgaccttcagatgcaagaagctgcccaagggaggggaaaggctcctggcagtggtttccaactctagctacttgttgggatgatgggtggaggcggggtgatgtcctcttaaaaagcatgagcatctgggacccactcctagagattctgatttgattggcctggggactctgacctctatcacagaagaagtgtcgcgtttggtagatgtgaggtagaatgggaagacctaagaaagcaggacagaaatcagggactcagtaaaggagcggtgaactgtactatagagctgcgatatagatgtggttaataagtcccttagccctccctgtttctgctccaattcttctgctaaacacggtctgctaaagactctccgtgaccttagagcaggatagaaccaaacttagacatttggcagcgcaactaaccttccctagccagcctatttcctagtagggaagataggtctccagtggttaagaatgtgggcatgagccagactgcttcaaggctaatcccagctcttccactcactagctatgtgatctttggaaatttacttaatctctctgcctcagtttcctcactagtaatagtacttcccaggatagtaccaacaggtgaatgggataggtacttctgttggctcaatttccagatgagacttacagatgctaagtaacttgcccaagacatcacggccagtaaggggtcagagctgggactggaaactatacctctgatacccagacaggggttcctgacatgcaaagagtccctggactgagtaataaatgtggtaaaactatgctatagacacagtggtggtccaaagaaagtgttcacttcatttgggtaggttagaggaggagaatcttgagctgggtcctgaaaaataattagaaatttgccaggaggatgtggaaggagatattccaggcagagggaacaacgtgtgtaaaattatggagacaaggaagagcagtttgctctggggaccatatggccatggagtaggatgtgttgacggaagccaatagtaagagggaggctgtggagcaatgtttctccagggttttgctgcatcagatatatattagtagcatttgatgtgcagattctgggcctctccccaggcataatgaatcaaaatcactgaggttagagtttggcaaactgcattttaaaggaagcaagccatatgaatgtgtaagaactaagattaggtgaaccacagacaaggatggaggcaaaaagtagatcatagcaggccttatgtatgctaaggtgcttggatttgggcagagccactgcaggtcagatagatcactggacacagtgtagaagatggaatgaaagaggtttgttggggagtggtgtctgatggtggtgagaatgcattctagtggggagatactagttttaagaaaaggtactcccgaactaagacaagttgggggcagtagaagagagaacagcagaaatacaagccatataaagcacgttgaatcatcagaagctagggggagagggaagggggaagcattgaggaatcggaggagtgttggttgttgggctggcacaaagtgactgcttggaactcagtgagtctttgatgtgctgcttgcaagggagacctgccagggaggagtgatcatgcacccagccttcccagatttcccagaggaaagcagcgatgtaaaatgtgaacatagcgtgactggagcaatgacatctgcaggtgacagggagaaagccatctgcttagctacagcccccctctcctgacactttttagttcatgatcatgatggtaaaaaaatttggagttttgatttggggcataagatgcaatgcaaagaattgagaaccattgtcttacagcaaagtactgacctattaaatatttgggggtgacagaaagacctgacattgaccatggggaagtgaagtaataatcacccttggagagtatcaaggcaaaagtcatgaaagggaggtaaaactaaaaccatatactctgtatgacaggaagggaaatgactgaaattttctggacaagcaccacagtgtctttcttcccgatgatgtcatttggttagaacaaggacttaaccagctactgaattattacagttttccatgactaactgactttttctgttatgtttggtcttaagctttctgttgcccaggagatccacatctacatgttcaacctcaaacccttcacaattattttttacataaaggactgtgttttttgtttgttttgttttgtaaaatcctctagattaataggaggcaacagtaccactcatttctaaagcatactatttataagttggtaaggttgttgcatgcttttgaacttgaatatttattttgtccctcttggaaacagtatctagcacatcactgtaaaacttgattttattgaatgccctttagtttctcttaggttaaaatgtggagcttatacagtcacttgtaatttcctcagtcttaccttcagattcttcctctaaaggatttttctttcttcctttccatttttactttaaaatgaattaagcatgataccaacttcatgcagtttcttattgtgaagaacacattggtaagattgaaatgttattagtctaattctgtgctatattttgaaataaaatcttctggaacaaatgtaaatctaatgattagaaaatgtcacttacatttctcaaaaaacaaacttacaagcaagcaaatttaaagatcttttttttttttttgagacagtgtcttgctctgttgcccaggctggagtgcagtggcacgatcttggctcactgcaagctctgcctcccaggttcacaccattcccctgcctcagcctcccaagtagctgggactacaggtgcctgccactacactcagctaatttttttgtatttttagtagagatggggtaagatctttagtttttatttgcaattctagaattaggcaacacctcattctatggaacagaatgagtattccaataagctgagcagaggaagttgactttatagagaggaaagggtggaggaaagcaggaagaggcagcagaaaattgattgtttgtttcagttactttctttgcaaaggttaaagcagagggggcttccttatgccagctaaaactggcctgtttggtaatttggctgttatgtttctctgctggtttcttgaaaggtcagatgaacaacttagtttcaacttggtggcatggaacttcagcatgaataactctattttggttttggtctgttgggtctaatacaggagctcagttcaaaccaatggcctcctataaattttatataacaattagtattacacaaactggaaagctggctttgcggaataagagcaggttttggaaatagctggactggatcttaatcttttctgtttctgctagccatgtgaccttgagcaaattacttgacatctctgtgccttaattttgacatctgtaaaatgggagtattaatactacttaatttcacaggctttttaggaggtttaaatggcaatgtgtgtacctggctcaaaattactgttagttatttttccttatctttttcttcttcattatcatgatttactttgttttcataacagccaaacaaggccaggcgcagtggttcacgcccgtaatcccagcattttggaaggcagaagcggggggatcacttgaggtcaggagttcgagaccagcctggccaacatggtgaaaccctgtctctactaaaaatgcaaaaattagttgggcgtggtggtgcacacctgtaatcccagctactcgggagcctgaggcacgagaatcgcttcaacccaggaggcggaggttgcagtgagccgatatcatgccattgcactccagactaggcaacagagtgagactctgtctcaaaaaacaaaaacaaaacaacaacaacaacaaccaaaaaaaacagccaaacaaggcttatttttccagaggcttgctacagttttctatgcctagttggctctgaacacattactaaatctgagcttttaaattagaataatcatgagttaaaacaaagtgaatttaaaattctttccttatttcttgaacttttgcttttaatgatagttgcaaagctcctggaattttccaccaagttatcttccacttggggcctcatgtatgcaaatgagaggagttgggtaatgaagagggagagggagacactgaacagggcaattatttgacctacattcctttactctggtgttcaagaggctttattcatatttgtgtgtgcagtcctttgtaactgtttgcaaatttcgtctcctcagacattctttcttcctgaggtaatagatgtgcacaccactggggcactcagacacaggtatgctgtcttggcttctctgttagaaaggaaaggctaaggccactacgcagcacagtgaaaagaagcagacttcagggtccccagacttgcatttgaatcttaaccctgggcaaattacttcacctcgctgagcatcaacttctctctcatctgtgaaataatgaagtagaggattacaaagaggatggcactgaacctggcacacaaaatatatgtttatccaataaaagtctccttgctgccttcttgaggagtgccagggatacgggtgaccggggatacaggtgtcttgtcacaagacggacaagcctgctggccaactgacagacaatccaacaggtttaagtgtgataataagggaatatgtgtaagtgtgataataagggaatatgtggtagtggtgagaacgtatggaagacttaagctgagacctgatgagtgagttaggagcttgccatacagtctggtgggagtgcaagagagagcctggcacacagaagtttcgtaaggctgcctaggacaggagggatgggttggggccagattaaaagggccttctcagcctcattttaaaatttggactttatcctaagaatagtgagaaacttattgcagcattttaagtggagaagtgatgcaacagatttggattctagaaagataacttaaggtagatattagatttgaggggtagctacaccattgcctggggtctagttcagttgggacccccagttgaagtcctccagatgagagatgatggaggactgatcttggaaggcttccaggaagaagaaagtagtgctttcattcattcacttattccccacatattaattgagtatctattatgtgccatgcactaacttcaaagggtatggtagtgaacaaaacaaagcccctacctcagtggagctacattcaacataaaacacagatgagtctatgagtaaatgaatgtaaacaaaacacagataacactctgattttatgaccaagttgatacccacctccctgaacccacctttagaaggagaagtcgagtgtaattgagcagttattactcaggcccacctctccaatgcgcagagatctctggggatatctcttaccaggataatgtcacacctgctccagcagccctttttggggctgccccctccctcactaacaagtactagaagggaaccaattcaaagccagggtcggaaactcagacacttaaaggggcagaatattgttatgagctttatggtacacagatggtatctggagcaagaacgtgaactttgcatcaagaccattgggtctgaggaacagtgacctcaatagtaattgctgctctgtggctgcatgacagtgattctccacatggggcctttactgactggtggcccgtgaaggtcctagtgacataaggaaaagctaaccatgccagatctttcttttgttgttaagggcccatgacctgcagtttccctaacattcatttttatacagggcagaggtatgtgtgcgagctcagataccttaaattcatatgcctttaatacaatccaggcagatttctaaatgagggatgcttccccacaaatggagagtgaaagtgggccagcctaaaaggacctccatagcactgtgcatggccagctgtttgtggctgtaccaaaaatgcaggtcataggatttttatgtgaaaatttctatatttaaatgttggcaactaagtctgtttttttttttttttaatatgcagtttttaatcatctgtgggctggattcttcctttatcttttccaaggctgccttgtaaaaacgtccactgctggcatctgcttttcttccttttcactccccagtcctgggtcctttagtctctcattatatcaaatacgagtgactcaaatttagccaaaattttcttgaatttatggaaaagctatatacaaaagtaagtttctgtatacaagtattttatatcaggaagaattttcagttggggatggtaacagttactgtaagtaagatatggttataaatgttgtttctctaaggggagaaatttctgatgtctagtcaatttacaaacctgtgttctagaacataaacatttgtttgtaagtaaaagaaagaaagtacatgcagatgcattaaatccatacttacacccagtatatatgagtacataatatacttttcttgggaattatcagatactttttcctgaatcaaatgatgaagactatttaaagtagaaaagagagaaaaccagtctattctgcatggacattttgttatcacttttatggtaagcagttccataagtgtgtgcctctgttttggcataataaaattttacattacttcttaaattaagtacaagttttgaaaaggaaaaaaaattaacctcctgttataatcaaaatctttcactttctaaaaatcagagtatcttcttttaaagggagttatttattcaataaaaattctatatttctatataccttacaattttttaaaattctggtacacacagtatccttataatcactttttctttctatttatatccttaaaaacatctgcacgaggtaggaaaaaaactcagattttaatgaaatcataaaaacaaaagaacttgatgcagcccacagcacctgctaaccatacaatgtgtttacagttgttattgctacaattaataatatcactattgtcattataagtgtgattgacagttgaagaaactaagtcttaaggaagttaaggccaccatggttataaaattagtcaattttagagactaaaccttattaaatcacaggtctatggacttaaaatccataacctttcatttataccaataaaaaacaaaagaacaaagagggccttttgttattgtaacacctttatgtgctgggtgcattgtccatattagcttatttatttatttttattttttggcaggtactgtatgaggtttcattttatagataaagaaactgaaaaagaggttaagtcacttaccaaggtcacattgcaagtaaatggcaaagccaaaaaaatgctcctatgtctgaatgccaaggctcctgatctcctggagtgcattgtatctaattgatagttgcaagtaaccagtattttacttttaattgatagcagacatttaagaggtgtgtgtcacttgcaactagagcaaattttcttcatttcataaaattgccagctacagtagaagaaagcagtcatcttcaatagatagggttttctgtaaaataaacaaaagggttttgtgcctgattttaaaaaaaagaattctatttctttccatgtctgagaggtgacctttctgatgttatactgtgggtggaattcattctggaggttgtgagtgggattttgggagtatgatgggaatgactgatgaatccatactccatttgtaagtggcttgtcgtgatgatgaatagagaaaacataaacagtggatatagcaaagtatcagtttggattaggtttaggtgtaagtgacagaaaatctaaaatgctaggacttcagaaaggatagtagcttatttctcatgcatgtaaaagaagtgtggaggtcaggagtcttaaggcaggttcaagatgactgaaggttttttcttttttcaatcctgctcatcctcaatacatggctttctgcctcatggtccaagttggctccttaaagacctgctattgtgttgtaattgactgtaggaaggagaaagggaagaagaagaacacatctcctttcctttaaggacacttcccagaagtcacacgtgacacctctgcttaaattcagttagccggaatttagtcacatggttgtgacctcacacacatgctgcaagagaggctggagaatgtattcttatcctaagcatccatatgcccagctaaaaggtgtgtatgtgtgtgtgtgtgtgtgttgcaaagggcagggggagttctatcaataaggaaaaaggagaaaatatattggggaaagactaataaagtatcccatagaaagaatcaatgaaaacgagttaaccatgcaacatagaaagattacttccattccagcctctattccagaatacctaccaagtcctttgcctaggataggaattctagaacagacgtgtgggtgtaagtcctaaactttaactctgagcacctgtttttcagtgaatgataaaaattgttaggagcccacatctttaaaaagaaaggcaaagataaccatatcctttatttttttgagcagctcctttgcacactgcttcactacaaataagacctacctaaggaattagatcatgcactaagtccaaacctgcagttacttcagaagcttgtgacttccattagaaagtctgaactctctaacgtagatacagaccctgcatgtgggggttgaatttcaaagttcttgtgctgctttcattggcatgcacccagggaagtgtatgtatacattgggaatgtttagggacctggctacttctctgttttcttctgtcacagcgttccttcgtccaggggaatactgaaataataattctagcaacaattttttaaatgccaaaccaattacatgtatatttcacttaagcttcagagcagcctgaatggtaggctttatccattcccattttacagatttagaagctcagaaacaaagtcacacaactagtaaggagatgtgccaagatttaaacttagatctgttggactcccaaatccataccctgcatcacgatggcctcacacctttgaaaaatagtacaatgacccttttgatgtttcttttttgtataatgacctaaggaaagcagagaggtcaagtcaactttccctggtccctgcagttgtaatagggctcccttcaccctctcagtgattctttactgagttagaggtaaaaccccacaatgaactataggaaatcccactcttttagagctctgagtatttagagactgatttgggctgagcaggtgagggagattggtagcagagagctggaactggaggcctgttctctctgtcagttcattactttcaaaggtctgttgcagggagcctccttgtcctcccagtgtaaggaaatataattgtgatcaatacatttccaaaaaatatatctccactgctaaggacatggtaaggaaatggaacaaattaataaaaagggcttctcagccaactggaaaagaggcaggccatgagtatacaatgtcttcctcagtttttcttccccagttaagcattctgggtcccctccctctcatttatttgctgctgtgatgtctgcagggtagggtgagctggcataaagtttattaaatagtagcttgcagatcacttgctaccacattttccaaagcttgcctttgtcccctcggtgtatacttgagatgccttcagtcagatgaaaatcatggaaaaccaaactaacctggcttcacagtgatgagattggttggctcctggttaggaaaggcttcagaatgtgtttgtttcattggcccaatggggcatcaccaggaatgctgttattttttttctttaaacttctctgctctgttttttgccgtcagtttcatttacagctatcctcccacaccttccggttgccaaatgattttcctttcctttgagtttattcatcactgtctagggagagggagaaaaagaaatggtcacttccaagaactctctcaaaagagccaggaactattttcccagtcatcctcagcagatttctcctcaatctcattggcccaaatagggtgtggtgtttatccttgaacccgtaagtggagccaggggatgggataatgagccacaagccctaccacctgatcaacttcccccaagcacctgggctttgcaggaggaattgaaggtgctcaaataaaagttaaggtagttactaaaagaaggagagtggtgttggaagagcaactacagtgcctattagactcctgctgttctgagaatcagctccaacccactcctagcagcacccaaggaactggggctcctagcctgactcacaactcttggaagctgctgacccctagtgtctgaggaaagcatcggctctagaatccagaggcatgggtttacctctcatgagaatcacagcggctgtgacacactcacacacacaaggaggttgtaagcaaattaaaacctttagaagtactttaatgagtaagtgagtttaattgaaagtcttccaaagacactgtaagacttaggcctccctcaccttgctgatcagcaacctcagaacactctctgtagtccttttcacacctgtaaattgtcatccacagtgtgtctttctctctagacagagggtgtgctttttgagggtggggcctaagtgcaaaacacccagctcctcaccttgaactcctgcatgcttagtaaacacttgtatgagtaaacgaaagacccaactgttgttcagctctcctttcctctccccttccatagccatggctttctcttataaatatcagctctaccagcttaattgtactccttttttttttttttttttgagagggagtctcgctctgtcacccaggctggaatgcagtggagcgatctcggctcactgcaacctccgcctcccaggttcgagcaattctcctgcctcagcgtcccgagtagctgggactagaggtgcctgccacccacacccagctaatttttgtatttttagtacagatggagtttcaccaagttggccaggctagtgtcaaactcctgacctcaggtgatccacccgcctcggcctcccaaagtactggattacaggcgtgagccaccgcgcctggccaattgtattcctaataggacaactaagcaatcaattgtgttttgaagctgcatgttatacgaatgggaaaatattccaacaaccccaaatacacatctaagcagctgcttttgtgttgtggaatacccactatctggtcagtagagaaagcagaattttttattataagcagatcaacattgctactgtgaattctttgagcagtaggcaaagctgtgttagaatgggttcttctttggtctgtatgtggcaggtaacaggacttctcctgtgcttcatgatttgggttaggaagagagaggaaaggcaacaacatggtaattataatatagaatgactcaagacaagaaagaataggtttttgttttgttttgctcttaattgacttgtaattcaagcgtgaaatgtggcagctttcaggattggagaaactttgcacaaacccaatattagaagttaactgccattagctgtggagggcaccaaaggacagagaggatttctcaatctgggagctgaaggcgagttctggggaacagcagcagccacagctgtagaaatcctgacagctgttcagtcttggcaggcagggctgctgctcacactggagaagctgcggggcttcctgagcagggccctccactcgcgtggtgcctgtaagacctgctctggagtggaggcatgcaccatctttcttttccccttttcacagaggaggagaaaaatgggcagataagtatcatagcggtcaggtaggtcatgggatagggaaaaaaatcaatcattgaaaaggagtgactggaaaaccacactgtaacattgtgccctaaagtattgtatcagttttgccagcctgcacttgtctcttaattatgtaaactaaatgctatgtgttatcaagattgtcattattacaattttgttactttgtagagaataaacatagataataaatattagttctacatttcagttgacagatttcacaattttgcttcagagtccttctttgggatacatcgccttcttgcagaaataaggattttgttcagtcagtgtttaacagagacttttaaaagctactaaagttgcaaaccacttaagagttgtaagtctatcatagtccacccatttgaacagtcccctgttttaacctgtatttgtgcttcggggagaaagtggatggaagaggctccacgctggcttagtcacactgatgtatgaataaacgggcaagtaatggatgacctggggttcatgccagccaactcacctgcacacctgctttcacaagcacttgacaaggcacctacctttcttaatgtgccaagtacataatctctctgattctgtaaaaagattagctgttaggaagattacaaaactttgggtacaaaaataagagtatttttagaattttgttctccatgtgttaattttatcttcagtgggttttgtttgttttgctacctctgccccacatcataatttatgtgtgtgtttgtgtgtgtgtgctgaatagatgatctctaagtaggaaaattctcttgggaaaaattctcagcatgagaaatgtggggaaaatacagctggacagctgtttaattttgccaagaaaaaaatgaggacttgttctttgctggtgcatgagacagggctgtgtcactgcagtgtgagttgtgaaggagagaagcaaacacacaggcaagtgtttacacctgctgccttcttaagtcctcccaataaccctgtaaggcaggtactacttctcttgtacagaggaggaaattgaggcctagctaagttatgcagtgtgcccaaagcatagctaaacagtgtggccaatttttaaatccagatgtttctaactcaagagccctgttcttcttactataccaaatggctcagccctcaagttgttgtcttagaaataaaaatacaaacaacaaggaacatttgttcagcttagtgtttctcaacagagtaagagatagcttctctggagcccttatgctttcactaaaaattcaattgttttgtttttattttgataagaacccattaatattaagcatattctggttcatcaccttataagcaaggactgctctgtgatataagtaatgctggttctatctgtgtttacattgacaccaaaaactgtttctcaacccccagagatttcaagctaatttacccaatatccattcttcccctctaccttactaacagaaccctaatttgcctggaatcagcaatagtcctatgcttctcagactcccttgcagttacaaatgttcatgtggcaaggttttagctcatgatatctgagctattagatggggcttcccagaaagatccttaaagtggctgacttttaagatagatagaggacatatcaggtattaagctggtaagagcaggtgctacatttgatctcagacaaaaggtcaagaagcaatggtcaatgtctttctcactctccagtctttctcctcatctagccaggaaggaaggtgagatatgaccatgagggcaagaacacatactagcgtggtggaggcaaagatataaggagtctgggtctctaatgactacaaaaaacccctcattataccagcccagggtgtggctgtctgcagacacttcattatatacaaaaaataagctaattacccccctctactaaaaatacaaaattagctgggcgtattggcacatgcctgtaattccagttactcgggaagctgaggcaggtgaatggcatgaacctgggagacagaggttgcagtgagctgagatggcgccattgcattctagcctgggcaatgagagtgaaactccgtctcaaaaaaaaagaaactttttttttctttcttttttttttttttattatactttaagttctagggtgcatgtgcacaacatgcaggtttgttacataggtatacatgtgccatgttgcttttctgcatccatcaactcatcatttacattaggtattctcctaatgctatccctcccccagcccccaaccccccgcaacaggccccagtgtgtgatgttccctgccctgtgtccatgtgttctcattgttcaactaccactgatgagtgagaacaagcagtgtttagttttctgtccttgtgatagtttgcttagaatgatggttccaagtttcgtccatgtccctgcaaaggacatgaactcatccttttttatggctgcatagtattccatggtgtgtatgtgccacattttcttaatccagtctatcattgatggacatttgggttggttccaagtctttgctattgtgaatagtgccacaataaacatacatgtgcatttatagtagtatgatttgtaatcctttgggtatatacccagtaatgggatggctggatcaaatggtatttctagttctagatccttgaggaattgccacactgtcttccacaatggttgaactaatttatgttcccaccatcaggtaagccgagatggcgccattgtactccagcctgggcaatgagagcaaaactccatctcaaaaaaaaaaaaaaaaagaagctaatttttaaaatagctttattaacatatgatttatagccaggtgcagtggctcatgcctgtaatcctagcactttgggaagccgaggcaggtggatcatttgagcccaggagttcgagaccagcctgggcaacatggtgaaaccctgtctctacaaaaaatacaaaaattagctggggcatgcaaatgtagtcccagctatttgggaggctgaagcaggagtatcgcttgagcccaggaggcataggttgcagtcagccgagattgcaccactgagttccagcctgggtggcagaatgaaaccctgtctcaaaaaaataaaccaaagggatataatttacataccgtaaaattcaccttttttgttgttgttgttgttttgagacggagtctcgcactgtcgcccaggctggagtgcagtggcgtgatctcagctcactgcaacctccgcctcccgggttcaagtgattctcctgcctcggcctcccgagtagctgggattacaggcaggtgccaccacgcccagctaattttttgtatttttaatagagagtgggtttcactatgttggccaggctagtcttgaactcctgacctcgtgatctgcccacctcggcccctcaaagtgctgggattataggcatgagccaccacgcccggcctcaaattcacctgttttaaatgcacagtgatttttagtaagcatagttttgttcaaacatccccacaaccaaatgtagaacctttctgttattcccaaaacattcctcttgctcattggcagtctatcctcattcctactaccaggccaaggcaaccaccgatccactgtctttataaatctgccttttctgaacatttcatataaatgggatcatagaatatccaatcttttacatctggcttctttcacttaacatattgtttttgatagtcttccatgctgtagcacataacagtagttccttcttgttgctgaataatattctattgtatggccgtattatattttggtcgtccatttaccagttgatggacatgtggattgtcttcactttttagaccttatgaataatgttgcatgaatacatatacatctttgtgtagatgtatgtttccatttctcttgggtagattctcaggagaggaattgcaagatcatatggtaaatttatgtttcattttataagaaactgccaaactgttttccaaagtaagcacactatcttatattcccatcggcaatgtatgaggcttacggttttttcatattcttatcaaaaattattttgtctttttattatattccttctactgggcacgaagtataatagcatctccttgtagttttaattttcatttacctcacgactaatgatgttgagcaccttttcaaatgcttattagccattcatatttctttggtgaaatacctattcaactgttgcccatttttaattggcttgtcttattattaacttacaagtgatttttatatattctggatacaaatcctttaccagaaatagtatttgtgtatattttctcccagactgtggcttgcttttcattttcttactgatgtttcttgaagcacaaaagtttttaattttgatgaagtcaattttttcagtttttcctttcatggattatgctgttgctgttgtgtttaagaactctttgtctaacttaaggttgcaaagatcttctgctttcttctacaagttttatagttttagcttttacatttggcatatgattcattttgagttcatttttgtgtatagtgtgaggtatctaaattcatctttctgcatgcagatatccagttgtcccagcaccatctgttgaaaagactgtcctttccccattgaattaccttggcacctttgtcaaaaaatcaatggactataaatgtaaagttttatttctagactctcaattctgttccattgatctacatgtctacccttatgccagtaccacacagtcttaattaatgtagctttatagtaagttttaaaattgggaagtcttaagttttccaactttgttcttttttaagattgtttttgcttttctaggtcctttgcatttccatatacattttaggatcagcttgtcaattcctgcccaaaagcctgctggaatttttataggaattatgttgaatctatagatcacgttgaggggcattgctattttaataatactgagtcttccaattcctttatttagatctttcttcttataatttctcttagcaatgttttgtagttttttttgtttttgtttttgtttttttttttggcagagtcttgctctgttgcccaggctgaagtgcagtggtgtgatctcggctcactgtaaccctgcctcctaggctcaagcgattctcgtgcctcagcctcctgagtagctgggattacagacacgtgctaccatgcctggctaatttttgtatttttagtagagacggggtttcaccatgttggccaggctggtctcgaactactggcctcaagtgatccacccaccttggcctccgaaagtgctgggattacaggtgtgagccatcgcgcccggcctgtagttttcagtgtataagtcttgcacttcttttgttcctaatttttcaagtcactgttatatggactttctgatacataaggccaaattgaactcatgatacatattcttatcaccaaataaaatggaaaatttaaacaagtggaggtgtacttaatatacataaatgatatttctatgttaaggccaaatggtgcattgtgtaaacgaacagtttcacagtggaaacaatggagaaaaccgaattattacatggcgtgcatatccagtccaaatgaaccttgtccttacagtcagtaccgtatgtatataagccaataaaacaacgtcacatggcacaataatcagtattgttaattgaaattaattgtattctatttttgtttatattttgtaaattcacttggatttgtataagtgttattagcaaaaggaatttacacctagttttacatgtattggctcaatatttttttcctttaataggtgttgtcttagttcattttctgttgccataaccgaatacctgagagactgggtaatttataaggaaaagaggtttgtctggttcacaattccagaggctgggaagtccaagaagcatggtgctggcatcttctcagcttcaggtgagggctttatgctgtatcacaacatggcagagaaaggccgagaaccagaagggaaagcaggagtgtgcagaaagggacaaaacatgagaggcagccttgctttataacagcctgctctctcagtgactaagagatggtattaatccctttctgagggtggattcctcaaccaaatgcctcttaaaggttccaccacctctcaacaccattacgttggggaccaagcttcaacatgagttttggagggagctgaccatattcaaaccatagcagctatctattttgtactcactattgtgaaacactggctctagtttttttttactttacaaagcattttcaattcaccatcttattattctcacagtaacactggagcttgggtaaaatagggctttttaaaattcccgtattgtaaatcatgaaactaagattcacagaaattaagtgatgtttgtaattgtatacgtccataagtggcagttctgtgattgctgagtgcagtagctcacacctgtaaccccagcacttaggaaggatctcttgagcccaggaggcaggaggatctcctaagcccaggagtctgagaccagcctgggcaacctggggagaccccgtctctacaaaagttttaaaaatttgccatgtgtgatgtgctcctgtggtcccagctactcaggaggctgaggtgggaggatcacttgaggccaggagttcgaggctgcactgaggagcgatcacaccactgcactccagcctgggcaacagagtgagacgctatctcaaaaaaaaaagaagaagaagaagtaaaattaggagttcaggctccaaatctcttactctttcctctatatctgtattgattattgatcacttccttaaaccctgctaggatacaagagaaatataaaacttttggaaagctttataggtaccaagataaaactaatatgaagcatagtaaagctagggttaatataatggaggccacagcccagactctagattctagcagcatctatagaaaacagacaactatccagacctgagagttgagtgggaaacacgccctgagcaatgcagaagatgttgtcaggcagcccagatctacaacactccctccacccgcttccaggagggaaggacttccttcttcagctgctggtaatgttggcagctgacagtgctcagctgagaccctcttcgggattgcctgtggctgaggagaactaggatgcccaaggtaggagcagtagcaacccatatccaaagacaggttgatgctgggacatgaaggcctggacctttcacccggcttggatccactttgaacgcccagccccgttgcagagcatcctcctggatcagtcaggcttttgtttgcagctgcatcagaattcagcctctccctctgccctgttttactgcctgtattccctcacaggtgttgccccagagcactctgaataaacttcctgcctgtgaatctctaccagagagtcagcttcctgcacccagtgctctataaggtttctaggcaacaggaaatgccctaaaggccagaattcctctcgcgggtatagcagagagtaaacagagtagtgttttgtagtggctacaaaagaaaagggcaatggtggtggactttaaaagacaggatgagctgtcagccctgatggggagcccccagaaagctgtagctggcccatgtgccgcacattttgccgagtagggatactgccgagcccccgatgttctgtttgtaaagtgggtgtgtagcccaggtatcagctctcatcttcactgccaactgtcctcttcagctgcagtcctatgaattgggccctgaagctggaaccggaagatctgattttagatctcccttgccaattttgtggctttgtgattctagaagttgtatttctcgtttgaaaaatgggtatgctttgaggattgaaatgatcctaatttcaggggctcttcatgagtgtcatgcgacaggaggatttcatggtcaagtaagtctgggtgacactaggccaaactaagtttaattgatttctgaggatttctcagtcttttatatgttgcttttccttctgagttccttaaggagggggtgtaatccaaatcatctgaacccatcaggaagacttcttgctgcggacaccctccatggagcattaataagcctggatcttgctggagtcatgttgagaagacctgtcccatcccataatggacagttaacaaatttaaaattagactctcttgattaccgtggtctgcactgccctaaccttaaaccaagttaggagtctcagaaatatcggaagagttcccagtgatgctggcactcatgatcgatgtgtttttggttatttacatttggtaagctgtaatttacctcaaggatacctccaaatctgtgttcaagacatgtatgttttaaagaatgttactctctcaagcttttagactggggagaaacgtggctttccaaggcatacactctcccttggaacagtagtagccatcatgtgttggaacttatagttgacaccttggggggatgaaatgatatgttgaaaaggacgccgaaggtgtgtctgggctgtgggaataagagtgctatgatgcattagtgatgtcgcccattaacaacagcattctccaccttcattttagaccacagttaagtttaccatatatactcctttaccttttgaagacagtaggagaataaattatttaaaccctctcaagtgcagtgtgttcaaaagtaactcatcatcatcttctccccttctatgccagttctctccatgtcacatgatggtggtggtctccaggaacacacccatgattcctacctggtcttcgtttcccataacccatcagtcaccaagtcttgccaatttaccttccaaatgtgtctcaaatcactccccttcccatcccagatgccacccccgttctgcaaatgctattaactgtcacctcaacctcaacatagtctctctgcctctggtcctatttatttatttatttatttatttatttgagacagcatctctctctgtcgcccaggcaggagtgcagtggtgcaatctcagctcactgcaatctctgcctcccaggttcaagcgagtctcctgcttcagcctcccaagtagttgagattacaggtgcatgccaccacaccaggctaatttttgtacttttagtagagacaggatttcatcatgtcggccaggctggtcttgaactcctgacttcaagtgatccacctgcctcagcttctcaaagtgctgggattacaggtgtgagccactgtgcggcctgcctctggtccttttttaaaatgtattttatttatccatttttgagatggatcttgccctgacacccaagctgaagtgcagtggtgcagtcatggcttactgcagcctcaaactcctggactcaagggatcctcttgctttggcttccaaagtagctaagactacaggcaaacaccacagcacctggctttttaaaaattaattttcatagagatgggggtcttgctttgttgcccaggctggtctcaaactcttggcttcaagtgatcctcctgcctcagcctcccaaagtgctgggattacagaggggagccagcccggcctctgcctctgatcctgtactctttaagctcctcccctaatctacctacctgactgcctattcaagtgtgtctcattctcaaacactgtaatgacttcctcagggtaaagcctaacataaattcagcactacataactcctatatcagccctgctgacctctggtctcatttcttaccactcccttgtactctaacaaaaccagtctgctgacctgcctaactcgtgctgtctctagcttccatgcctttgtttttgtggtaccctttgcctgaaatgttttgtccactctatctctttcttgctcagttaattcctactcatcactgaaacgcagagctcagacatcacccactccagaaaatctttcctgaccccccggcttgattagagccctaaccaattatatatattgtgctataaataaataatataaatatgatatatagtataattctttgtttatgtgtctatctttgccttaaggctgggactgtgtcttatctctgtattccttgagcctgttaccatgcctgcatttatctcaagcgcttaataaatatgcgtggattaaatgaaggaattaaatacctatgatgaataaaactaagctaatagtgacccatcaacatcagaaatataaccaatacttaggtaaagaattttcttttgcagactaagaatgattgctttgcatggctggtgaagtctgaaggagaaaagcaagcaatggggtggggtggcgggctgcgggtggcggggtcgaggagaggtgcattgtcaatgacagcagcactgagcagattctaatgacttcactgtggtacaaagcaacctggacactgaattgcatctggtttccaatgaaagagaaccacttagagtgcttagctgggtttaaagcagtttcctcacttttgtgtggccactctgggtgtttgcccgtatctgtacttctgtagctgactttttaaaatgcctgaactttggcttgtttttcttcatggattactaaaaaaaaagaatactttcttctactaattagattagattaaagttaacccatgggaccctttggcaaagtactgagtagattaatacttcttttcagctagagtttttgttttgttttgtttctgacaacagagaaggaatggagtgtaacctgttaccttctggtgaaattcctcattgtgcttttgtcgctgtattcttactgtgtgcaagacccgccagtcacaggctctaagtctaagccttggtttgaacggccttgggaataaagtaggtttcccagaccctccctagggccctcattgttttgattttcctttttacacatatccacctacagtgtgctacagcccaaaacccaaacttaaaaataaacatgcagtccccttttatttatccaatggtgagacaggccatcagcagctgcagtagactgaagcctagaggtagaccctcaagtcagacaacagccctctccacaataatcagccaaggagtgttcacaaagccagcatatcttacacccaagcaggacaggagtgtggatcgaggagtaagctgctgtggtgtggaaatttcatgcatcctcaaatgatgtagatgaagaaggcattttacatcaaagtagcaccttctatgctcttatcgtatggccccagagtgctgtgcctaatgctaaagttctggggagagaaagtggttgaaaagctgtaaacaaatagttgggtagactttaaagtggggacaataacactctgagattcaaagtagaaaagagcaggcaaagtgcagcattgatcacttggaaacctcctgacattttgtcaccagcttctctcctctatctcccctctgaggatttactaatcacctcagctttgtgtcatcctccccaggaaggggcagtgtggagccgtggtagagcactgcctgggaatctgcagggccagtggggccacctgcccgcagcagagcctttgtgtgaccgtagggaagcctggggcagggaaccactgcccctgctaccagcatgctgtctgtcatcagcaccaggagctgtgccaggggctttgcaatcctgatcttatgcagccttcatactgcaagcagcacttgctggagcagcctgtccaaggtcacagagcaaaggtcagctgtgtccagcatggaggccctgctctagtccatggtcatatcacaggtccttttcctttttgacagcatttggcttttgtagattaacaaaattatatattccaagttcttaattttaattgaaaaaaaattaactgtgtggtccttaccctctgtcttagttgtgtattgctgtataaataatagtttactacagtttaaaaaaacagacatttactatctcacaatttctgatcatcaggaatcccagagctgcttagctggtgtttgtggcacagaatttctcatgacactttaggcagaatgtgcattggggctgcagtcatctgaaagcttgactggaactgctggagggtcctcctcattcacatgactggaggctggagccctcaattcctcaccacgtggccctctccgtgggctgtttgtgtgttttcatgacatggcagataacttcccccagtgctggtgatcagagagaaagaaagagtgtgggagcttgggggagagagagagaggaagaaagagatggatggatgaagctgctgtgcctcttttgacctagcctctgtggtagcaggtatgtcacttctgctttttgtttctgtagaataaagtcactatatccagcccacacttaaggggaagggaattaagctctccttttcaagggaagaatatcaaagaatttagggacgtattttaaaaccacctaccttccccaacccatatatgtaaatcttctgaggcaaaaaacaaaacaaaacaaaaacagaaagaaaaaagcccagcatcactactaaaagtaaatggcactgctctttatctgcttgactgtcacttgcatgttctggtcaccagtggctccagttaaaaaaacatttccccttccctaaactgcttcataaggaatgttttcatagcagagaaatctttacttttcaaaggaatttatggggactggaaagtgtagagataataatagtttgtcctcttgattaagccctgactctagaccaggcagtgtatctaggactgacttccattctttgtactgcaggccagtagcctaagggaagccaccaggtggctgagctggtgcctgggcccttccacagattcttctgcaggtgcttccatcttcctgtcacccttaggtgaggcgtagccctcagaggatgagggttagcccccagctcattcctgcatgatattcctagccacaggccagatggctcaggtaaccagatcctgggagccatgtctcccagagccagttgatcttggttgggattggccagatatttctggcagttttttggggggatcacatagacttgaatgaaagctgtacaaggttacaaggctcacacacctggcaaccaggagaactctgctgttggctcttcccacccctctgaccaaactcctgatgaacattctgaaaaaaagacttctatggccccaaaagagcaaccctaaagttaattctgtagtttaaagtgatttggggggtaaaggagcagaaccaattctagaataaaggtgtttttacagcccacctccagcccccacaaccctaccttaatcaaaataagtattaggaacttattccacttaaggataaatcagacactaagcctaaacacttgaaattataatttcttcctgtgagatgaaatgattaaaatttctacaaattatgattacacacagatcctttaaagaaaaatatatatgtatgtattttcaaatgagtttatcaatatggtatagaatattttaaaatatttaactttcagtctgtctgaaatgaaatgaattttagtttataggagtgggaagtaaagtaactgaaatctgaagaaaagtaagaaaagaagattgtgggtgcaagagtgttaggaggtcagggttgagagagatcagtagtttattttttaggcatgatacctttaagatacttgttaaatatgcaagtggaaatgagcagtaggtggttggataaaggagtctggagttcagaagaaggtctaggctagaggtacaagtgactagccaagaaaatggatgaccttacccagaaagtgagtttagattgagaagaactctaaggactaatccttggatattgtgtagtgttatacaatagaactttcttccaagatggaaatgttctctatcgtcactgtccagtacaacagccactagacacatgtggctgttgagcacttaaaacatggctagtgcaactgggaaactgaatttttaattttattcagtttaaatagccacatgtagttagtgactacagctccagtgggtaaaagtggaagaaatgggggatgagcaaaggagaagcctttaatgaaggaaaagaaccagaggagaacgttgtcttagaagccagctatgttgaacgttgctcatagatctagttgaggaagatttaggatggtgtagcatggtgaagacaaaagcctgattggaaagtgttcaaaggagaaaaaaggggagagagaaattgtagacagcaagtctggacaagtctttcaaggagttttgtggttgtctaggagagtgtgggagtaaacagacagggaaaatgtagagagggccaggcagtgccgagggcgctcttgaggttagtggtcatgaatttaaatgagaccagttagtgtgatcatacagtcattcccccttatccaccgaggcacattccaccacccccagtggatgcctgataccatggatagtactgaacgcaattgccatcaactgaaacatgtttctgtccatgtcttcaacccataaatttaatgcctttccatcttaactaagaacttatacactgtgctgtaacttctgcagttcgaagcatgacagtgaaactagcacaaatttatttttcctttttcacaatttcacagataaaagatttggttttattgtaggtcatagcaacctcagcattcattttttttctttccttattaagtcaagaacttttaccttttcacttaaaggaagcactttacagcttctctttggcatatccgaattaccagcatcactactctttcatttggggccgttattaggtaaaatgagggtcacttggacacagcactgtgatactgcgacagttcatctgatcaccaagccagctactaagtgactcacaggcagggactggagacagtgtggatgcactggacaaagagatgattcggtcctgcatgggacagagcaggatggtgtgagatttcatcacgctatttagaatggcactcaatttaaattttataaattgtttatttctggaattttccatttaatgtttttggaactttgttgactgtgggtaactgaaatggcagataaggggagacactgtatatttttctccagccacatatgtcagctgagagcaggcacagagtagcaaacagctgaatttatccacaggtgggatttaaccaagtgaatatgaagtgagggggcaagtgagaataattgattgagttaagggttgcaatgataggtaagggaatctaagacacagagagagaggagaggacaccctgagagtacagaatggtgaaaagtggacagtatatggggtataaggcctagtgcaatggaagaattattggattaagaatagttggaaagaatgaactggaatgacaatgcaagattgttggagaaggggaggcttgaagatgaaattatggagggcatgaagttgttggtaatggcaaaataggatatggccatgggagcaggtataattgagatggaatggaaaaagacggaatttacaggccaaaattttgcagggaccatctaacagacatggaaatttccaggatttatataggttggtgcaaaagtagatgcggtttttgccattacttccaatggcaaaaaccgcaactacttttgcaccaacctagtaacagaactaacactggaaaatgactcttcaagacatgaggcagagtaatctggggaggaataggtggctgcaacggggagggctaactggtgttggtatcagcagtctgcaggtaggagattcagagcagggtgttaggaaggacagacaattaattgtttgcaagcaagagagtagcaaggaagacacctactcatccaacaggctgtttggcaagagggaggtgggagagaaaacagccacctcttgagagccataggagaaggcagtgccttcaggctctgttagagcaagacagtgaaaggaacgcttatgagagagggcccaccgaaaggacttatgatggacttggggaggaataggagttggccagagagggttggacagagccatatggaaaggagagtgaataaggaggtgaatgagggatgacctggagttgaggagtataaattggagtaagaagtaccttgaggtgaagcttgatggggtctccaagacagacagtagacgtaaaggtgctagtgtgggaggcaagagaagagttcatacttagagcaagatctctggatctttggactgacagcaatgggcggtaggtggtcttatgaagaggatgagggtcatgaaggaaacctcctcgaaaattacagaatacccctcaggtgtcctacagttcctgcatctcttaacctgctttttctaaacttgaagcagttatgcttaaactcatcaacgacctcagttagattcctcttctgtagtgtggagttaatcctatggtagagctcagtgttggagcaaggacaaatgatgacaatgtcagggccagcgtgggtcccagcagtggtgcttggtagaggtcagtttcctcctctcctccctcagctccctcttgaatttcccctcctatgaagggaagttgtctttccattggtatttgcatgccaaaagtcgaagatgccttttccttcccagactgaaaacctatgtaattctcgacataaatgactgtatgtctggtttctctctacttccatctgcccacctttgacaggcttcatgggtatgtgacctccgtaggctttgaaaggccctgctcttggtttaatgttctgctgttaccaccctaaaattcttaatgttttaacaatggttccccattttcattttgcacagagccctgcaaagtgcccattctaaaccctaaaaactaagtaactggtgaaacatgaccacgggacagtcaggtaatttgatttatcatcccattaatgtgtcagcatttcaggatgaagggtattttgaaagtaatggaaaacaccttaaccatatcctttgtaaacaagaacgtaattgagtacatctaaacccctatgaacgcccaacctttaatcttattttttcagcatgaaaaaacatcatctctttcagaaagattcttcatttattgtcattaaccctcatattaataaattgaaaatctgaaagttattcttaacttcaagtgaagcttgactgaattattattattcatgccaaacagagcattgaattctttctttagagcatttcttacctggatgtagaagtgctcttgttaattttacagcagacatctgtttcctccaatgtgtatgtccaagaggtgtagccttgagatgaggaaagaaataacatgggcagggcaggcatgcataccagactggatcgtcatttgtcatttatctggacagaaggcatactggcctcattccactcaccagctgggaagaacaaactccctacacagatatagccatcaaacttagattatggtgactaatgctaaatgaagagtccacacgggctttctaggttcagcagggccagacctgtactctatgtactcttgacccagattcagaattaatttatcaccttgacaggcaaccaagtgcctggagtactgaaactttagtagttatttaatgtgggaatcacagtaatgatgctgtaatataaaacagcaaatatttcctagagggacagcatttggattggagagagactcacaccacatccacaatttcttcttcaaacattagaatactttttggaaagcgacagcctaaattgtaggttgtttcttggttttaactgtcatttgtatttgtttgttttcctctaagaaaacaaatatgctctttttttcttttctttttaatttactttttttctctcacctaaacccccatagtagacaggcaaatttaaaagtatgtctttcaaaaacccagtttgtcttcctactggccattttgccttctattctctgattagaaaactaattgtgatactttattattctttagatataagaattctgactttttacacttatcaatagacttttttgaagtgtacaagttggcaatattaagttatttgttttgctgggctatttctggaactaaagatttatcacataaggtgacaaattgagaaaaggaaaaaaactaggcttttttttcttcttaactaatttttattaaattgggggcatctagttactgcagttgagtaagtgttagccttacctgggaagctgtaaatgattattttgccctcaagtgcagctggcagagtcatccatgtccctgaggcacatctgcagagtgagtgggcccctttgagcctgcccaagccacagctcacagtgaggagggaagtgtagcccaaaggtcttgccaggcttagctcacaaggtggcagtcacttagcatccaggaaagcttcattcattgtcttgaggtgagcaagtggccacttgaccagctttcccacaggtagtcaatagaactaatgacagctggtcacaggcacactcctgccctcgatcccaaggccctaaagtgagagaacttctcgagaatttcattcattccaatattttttggacacctactatatgcctggcactgtgccagatgctagatgggcaatggttgacgtgatacatatggcccttgctctctcacggagcatacaatctagtggagcaaatcaacgttacaaatcccacaaattagagggaaaaaaaaacagtatgctaagtgaatttaaagcaggaccttatttagacagggggctaaggaaaaacctccaactttaagcaagagaggtgactcaggtgaaggcagagggcttacaggttgagaaacagcttgtgtgagggccctgagacagttgcaggcacgagcttggcttttccagaaaactcaaaggccaccagtgtgcctagagctgtgtgagcaagattttgagaggtgcaaagaagtcaggagggtagatcagggccaataacataatgctggataacagcattagagatttaggattttatcctaaatgttgtggaaaaccgaggagtttgaaaccaagatgtgacaaaatctgattatgtttttagaagtatttttaattcacaaagggtaaggtttaatggagggcaagcccttaattttttgtatcactttgggaactaaatcaaggagcatgaaaccatcaaaatgatcgaatcaggggcagccgggtgagtgagtggggctaaatttgtgccatctgaaattagggtcaaagttctgatggcttcagttgtagtgacagttctgctgcagaaatcccgtctgtcctttggaaaataaatttgattttaaaaacctcaaaacatagcccaagtagcttaaaccatcagtacaagtttccactgacatctgccatgcaaatttgtacttcttcagccagttgctcttcctcacagttaacgctggaaatcagaggccatgagaagaaagcaagtgtggatatttgggcatggtagatggtgttcattttcctagattttaaaaatttgattgaaagtcaagagtgaaaacaaaccaaccctaaagtcccttagcatcatctcagataaggggagaagagagatgttggaatgaggtaggtaggtttatctaagatgctgaaactcagaaggactgctcatttctatcttgaccttcttagtaaataataaaaaagccccagcactttcaacaagtgaacactttgtgggcccaacttatgtgtctgaaagagactctctttgctattcaccagggaaaactggtttaaattggagggttttagaagagttgggattaatgtgcagattgattttactgcgtatgaatcttctgtgactgatggtttaacccttctcattgagaatgagtttacctggtgtcatgtgttgggagtagcataatttcctgatcagtacctttataattctgaaataatttacttctaaaagatgagaaactttcttaattcaatagctttaggacaaagcaagttaagtaactcaaatgtttttgtgacatttttcttttacttcagaaaactttttagaatagtgtttcttctactattcagatgactaaaataatttgaatatttcttctgagagaatgaaaatgagaaaggatgtacgaacagtccatgtcgctgcttaactcgccctagaaaagctggtcagagaacagacctaaggaaactctttagtacgaaatttcattataactaatagcaatagcatttcagcactacctctgtatttaaaaaagaaaaaagatttagggacccttgacaaatttaatagctccttagagatgatgttaacagtttagtcataaattttatgtttctgtcctgtgttcagtgacataccaggaaaacacattttcagaaaaggtatgctatgtaaattcttttcattactattttacgttatcctacaaaataatttttttgaaaatagaagcctgtaatcccagcactttgggaggccgaggcgggtggatcatgaggtcaggagatcgagaccatcctggctaacaaagtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgcgccactgcagtccgcagtccggcttgggcgacagagcgagactccgtctcaaaaaaaaaaaaaaagaaaatagaaacgctggaaatatttttttaaatagtaactctgattttcatagtaaattcaattttcataatgaactcatgatctagtgtgtttagtttttgaaatgtccatgatcaatgtaaaaagaaaaaacaaactcatcacctttactctcattaaatttctataaggaagaccttcaattgaaatctaatttttttttgttgactcacccaatgctatatataatatattattgttatattgtattgctgatgtggaaaactcatgatataaaatgaaattgatataaaaagacagccatctgacagcctgaaagtgggcggcaggggcagtttataactcaattcatattgtagattaggaaatagaggctgacagctatgaagcagtagcccaaggaaacacacctaataagaagtgcagtcaagtccagaaccaggtctttgatttgatccaaaattttatcaactctagaaccatcaaagatggcctagattgcaactttggatgaattagcattagtgtaacctttatatatatatatacatatatatatacatatatacgtatatatatacgtatatatacgtatatatatacgtatatatacgtatatatatacgtatatatatgtatatatacacacacatacacatacataccaatgtagctgaagatttatgtatttatattacagttattaaaggtattattgaaatgttaatgagaaaatgtatcgtacttttgacatttttttttcataatactatcccaaacagattaaaaaacacaatagtccactagagggcacctttcttcaacatcacggtctgttctcttccccagtactctattaacctggttttaatcagccactatcgcctcggagcattgaaaagcttttttattgtcagagattccatgtactgctttagcaaaatgcatttgtattggtaggcaaggctatctgtgctgctaagatacctggaatgataaaggggaagcatgacccttattcccctacacacatacacgcatgcacacaaactttgtgttagtttgagcttagcccttcttgacatgacaacccaacttatttttatttggaaagtcttgccttagccctggcaaatttatactacttttcactttttctgccactgcgttctctgactccaaatgctggaaaacagagagtaaaagagatggtctttaaatgttgacataaattggggacgaaacgatgtagacttcacccagatttacctatccgtcagttgctgtttttctacagcatgtgaatttcagttactgttgggcataaaatactatgggaaaaataataggattgtgtccaataaacaagtactctggcagattctattgaaatataaaaccatctcattattctagaggcaaagggaggctgcctgctatagcattgcctaatgtattacatttcaaactgtgtctgtagaaacccagggttgctggagatatttttagagattaatttgtacctattatatgagcggctaaacatctcatccccaagccccccaaaaaaaatcaaactggaaattaaagagttgtgaaatgtgaaaataattcagaatacaactacaaatgagatagtctatgggactttggagaaaagtcctgtaaagctgtggtaagaagaatataacgtttcagcccaaactgtaatgatttaattccctcataatctgtgcaaagtatttctctcaacccaatttttcgacgtcagcatatttaatttatcctgccaggtgaagtagtctttcacagtcctcaaaatcaacgaacttataaatatgtgtcattgaccatgaaggtggtagctctgtactggcctttctaaaaaattcatgcctgtgcatgcccaagcaataaaattacgcaagttgcccagaggcccagcttggttcagtgccaggttaggatcaggcacatctgtttggcacagtctctcatcaagcctaacagtcggttgtgcaatgacaagcaaacacccaatatatcaaatgagaaggtactgttatagattaatgacctattgtaagtttgggtactctgtcttatcttgtttataatcagaaatatgagtaattgctatatattgttagtaaaccaattttgaataagtttcttgctactttgcttttaagattctggacatgtttaatgaagaatacgcagagattgcaacataatccattaaaagaaccattaccatttacaactacttacttgtgtgaaacaggattctttcgatgtggcacaaccaaacaaaatcttattccagatgtagctttacatttagttctatgtaaagctatatctggaataagattataactgacatctataaattctgctttctctttttttgtatcacaaacagcatcatgttctcattgagagacacatgaatatagatttgaactcagaataattttatcctgatagaaacatttgattgttttgcatgttggttttcatattgattttcattttaaaagcaaattctagtatttaagaaaatagaagaaaaagtgacaaccaattagtgattcacactaataattttctcaggaaactatttttttcatataatgtgaaataataaacataagcataaccaaggtcagaatagtccaaacttctgagtaaattaatttacataggttataagactctcaggtaaatttcttatttataattataaggctaaaaaattataacctgtctcatttttattcttcccttactttctatttttgggcctcagagtattgttggaagtggagaagtatcctgacaccagctgtcctcttctggggctctgttccacatctatagtgtgggaaatgaccttgacgcaatagtagcctgcaagtacactaccagacattctatcccagaagtcacaggccaaattaagatgttcagatcacacagttctttacctctatttaaaatgcaaggcaagaagcaagggaaagagatgggatgagctgactacttaggatatggcacaggagtatggcaggaccttgagttacacaatatttatatgtccagcctctctgccacaacagcctttcctgttgaggatatggttatgaaccacagttgaggtttgagaaaggattcctgttccacttagacacaaggtatctgccagtgacacacaacttgctttgtaagagacagagccaattccctctggcttcctctgtagcttgcctcttagcctgatgagaagctggggattgcatttacatttcttgggcagaggacacattggaccagaatgggtgtcatcaatgggaaatcaacataaaatctaatgaatgagggcctcatgtggctcagatgatttagtgtgtcatgaatattaggcggttctttagtcttttcatccctttctatgcttggcacctacacacttgatctaggcttaacaaatctgctactaacttacttattgatatttaacacatctcatgaattctgactacagtagtctcccccttggcctgccagggatactttccaggaccctcggaggatgcctgaaaccgtggatagtcccaaacccaatatattatggttttttcctatacatacctattataaagtttaatttataaattaggtacagtaagagattcacaataactaatcataaaatagaataattataacaatatgccagcatcatggctcttgcattttgaggtcgttattaagtaaagtaagggttacttgaatacaagcattatgataccaagacagtcaaactgatactgagccagctacttagtgactcctgggtgtagagtgtccacagtgtggatatgctggacaaagagaggattcacatcctgggtaggatggcacgagggttcatcagaagaatggcacagaatttaaaacttatgaattgtttatttctggaattttccatttaatagtttcaaaccatggttgactacaggtaactaaaaccttgaaaagcgaaaccatagataagggggaatgattgtatgtctgtttacttactcattatctaaatgtaacacatacatttcacctgtgtcttataagctactacatagtcattatctatacttaacacacgtttatgagtttcatccatcttctttttcttgttcatctgtagcagaattgactgttgtcaaataatacaacaaagcccctacaaaatctcttggaaagagatttcttactggtgcagcctctgattccacatccttgccctaggggttttaacctgcagcagctccaaccaagcagctttagggaccagatcaaggccacccagccatctgtgctcctgtatcttcccctatcgccaccacaacttcctctttactcgacattaatttgtaactttactcaccatatcttcagtcccaagactgaatgaatgcctgccagacactcctgacccagttcttctagcacctggcccttattttctattcaccatcatcagtttctccctttgctggctcctttcctgctgcccacctagacatttgggtctcccacatcttaaacatcagctacattggcaacctctccaagctaccagcctaatgctctgatttattaacaagcttgttcacaaactctcaactcagaccctcaacttcttagccacaaccacccagcttccacccctaacacacgactactgaaattattcccttggcataactcgtgacttcctaatagtccaaattaatggcttctggttgtttttctcctccgcgtccctgcagtatttgaagaaactaggctctgtcagcgttccctctcttcttgtcacttctcactgtgttagttttcattctcttctcactttgttgactatgtctcctttgcatccccttgctctctaaatgtgggcttcctacccttatctgcagtctcattttccttagtttcagttaccatcggtcaactgtggtgtgaaaatattaagctattttgagagagagaccacattcacatgactgttactacagtatattgttataattgttctattttattacctgttattgttgttaatctcttactgtgcctaagttataaattaaactttatcacagatatgtacgtatgggaaaaacatggtatgtataaggttcagtactatcttcagtttcaggcatccgctaggggtcttggaatgtataccacatggataaggagggactactgagttagttttctatttctgctataacaaagtcttccaaatttagtggcttaaatcaacacaaatttattggtattataatatcaaaagttggaagtcctaaatgggtctcactggactaaaatcaaggtgtccactgagctgcattctttctggaggctctagagaaatatcagtttccttgccttttccatcttctagggacagcccaccttccttggcttgtggcctcttcttccatcttcaaagccaacaacaacattggaccaagcctttctcatactgccgtctctggttctttctcttatgcctccccgacttttactttataagacccttgtgattattacattgagctcatctggataaccaggctactttccccatctcaaagacagctgcttatcataattttaccttgccgcttggggattaggttgtagacagttgacccaggagacaggggacattattgtgccttccacagtgatgtctttgtttctctttagttctgtctctacaatctctcccttaatctaattcatttttacagcttcaactgtcctctctgtgcaaaagacccctaaattctacctgtcagcctgatctctcttaagctccagctgcctcttacaccttcaactgcgaattttatgatgaaaatttaaacctccttactctaccccaaccctctcagaatcagttccttctgctaacttccctgtttcttttcacagcaccagttttactccagtaatggtctcaaaacctcacaattccttatcttgctcactcccccatgtagatcactgcctaagtgccatcagttccttttttggtgtcttgggatgcatccctctgtctttgcccttccattcccatgatctcctctatcctccaaaggactctattccttggacagttgatgttgttcttaattaggagaagaaaacatccatttctcttcctttcctgagtacgtaagagctgttttacattactcccatttcatcatgttaccatgagggtcatatgcatttattcaattgtttcaaagtatttattgagaaccaggtactatgtcagacattggggatatagcactgagtaaaccaaccaagatgtaagttctaaggaaattcacattaatctagatctacaaaatacagacattaaataagtgaataaccaaatgaacaagattgttgcagtctcctggttcactctagctgagcgttctcttctcttgaatttctagtgagcaaacaaaatattcggaggcatttaactcatcttcgtcatatctagtcatttgtgtactgcctcatttctcttaccaaacttctcgagggcagaaacactacttcacatggcacatgataggagcttgtttcaactacaaaaatcaaggaagatgttgaggaaaacactttgtgtttctgcgaagcatttttaaaggtttattgtctgtagatgatgccagttttgttggtggcaacaatacaggttgagcattcctcaaccccaaaatctaaaatctgaaatgctgcaaagtcccaaattttttgagtattgacatgatgccacaagtagaaaattccacacctgacctcatgtgacaggtggcagtcaaaatgaagtcaaaactttgtttcatgtacaaaattattatgaaatattgtataaaattaccttcaggtgatgtgtataaagtgcatatgaaacaaaaatgaatctcgtgtttagacctgggtaccatccctaagatatttcattatgcatatgcagatattccaaaatccaggacaattctggtcccaagcattgtggataaggtttactcaacctgtagtgacaagtaattctttgggtgcggcattcaaggacctagtttccctgatatccacagtattaatttttctcgtcattccttttctttcattgcccagtaaagaagtacaacttaagctatatgtctacttgctttccccaatttcctgaggaaaagcttaaaagttattacttaagatggtgacttccctgcccatctttcccacccccaatacttcattttttctaacatttcaatttgaacagagtagtaacaacatagtaagaacagaatggaaggggttttggacaataaatatagtggtaaaaagtcatatcctcaggccatctgagcatacagtttcaaaagtgagtaactggggtcaggaactgactggaaggggcatatgaaactttctggcataagccgtgtgagttaagtgcaagagttgactttcaagtggactttttcccacaaatacccattgctgcaccacttagattcaacaactgatatttaataaacttgctttgtcacagctttccattgacctatccatctacccatccatcaattcctctcatttacttgatgtacttcaaagtaagttgcagacatcagtaagtgccctaaatactttagcctgcatatcatcaatttgagttcatgtttattcttgtttattcttttggggtaaattttatgtacaaagaaatgcacatatcttaatgttttattcaatgtgtattgacaaatatacacacctgtatagccaaacacttaatcaactcacacagcttatgccagaaagtttcctatgccccttccgggtcagttcctgacccaggctattcactttcaaaactgtatgctcgatggcctgaggatgtaactttttactattatatttattgtccaaaaccccctttcattctattgttgctaattgccacaattgaaaaaaaatgcttttctggatttaaagacacaatagtttgtaggtggcagaaacaatattttaataaggaaataatctaatttttcttcccttaaaacataccttgaattgagttttaggtagacccacgctgcagcttcactcttactttatgatagattttgatttcaagagcagcctcagttggctcagtcaaaaggggtttatttctccaagtctggtgggtcctcagttagtattcgtcttagtctgttagggctgctgtaataaaatatcataaactgggtagcttataaacaacagaaatgtatttcttagagttctgaagactgagaagtccaagattaaggcagtgtctcatgaggccccgtttcctgatttatagatggcaatggcatcttcttactgtgtcttcacacagcagaaggggcaaggtagctctcttgggcctcttttaaaaagggcatggatcccatttgtgagggcttcaccctcatgacctaatcacccctcaatggccccaccttttaataccatcatactggtgattagatttccacatatgaagtttgagggcacaacattcagaccataggagcattgttttctatggaacacacttatttggtatgaacccagaaaatcatgtttgtttctttgttttccttgctttgatggctttttgttgttgggcatgccacaactttcttagaccttggtttccatatctgaacaataacagtgtcaggctaaatgatctcttgaggtcccatctaaatttgaaactcaatactttttatgggaagggaagctgtgaagatctgagaagaaaaaaaaaatccctatgctacaaagactatgctttacataaaaagttcatcaatattttttagttaaagataacaaatgttactgcagtttggtaaactattctagcttaagtgttcttggaacagctggtttctgtttaaagttttttgcactagcaaatcatacttcaaattataacacaaagttgtttccaatgaatgactataaagagaagcctgtctaatatattcattttttttcatcttgtttatacctcttgggagagtttttttgacaggatttgggatacaattgtcagaaatctgttctccctagagccacctctgagtcatttccactatttatggaacagcaactgtgaagagtggaatcatgtttagacttttttttttttaacaacacatgataaatgtctttgggagcttatgtaatatatcccattgtcttcagttttcagaaaagacagagtccaggaagcagctttttaagctttgcacagcttggaaacatgttcctgagtcttagggtcatagattgtcaaggtagtaacttgagtaaggttttaactgcctttgaagttagagctgttctgtcttggaaagtgttttttatattaaacagatttccacttcatcttatctgctaccttgcaaagtgaacttttttcctttggcctgctcttctttgctcatatttagaattccagaaccttggctggacacggtggctcaggcctgtaatcccaacactttggtaggccaaggtggttggatcacccaagatcaggagttcgagaccagcctggccaacaaggtgaaaccgtgcctctactaaaaatacaaaaattagccgggcgtggtggtgcgcccctgtagtcccggctactccgggggctgaggcggaagaattgcttgaacctgggaggcagaggttgcagtgagccgatcacaccactccagtctgggtgacagagtgagactccatcccccgcccgaaaaaaaaaaaaagaattccagaaccttgttgggtggttgtattgcaaggcactctacacagaagtctctctcagagaagaatggagttttaggatgggggtgtattgtttattgtttcttatccctgaaaagtttccatcttcttgtcttcatcttgactcattccctacccccaggcttctgctttattcatcaagctttcattgtgcagccagtgagcaggcctagaaagtcctgcacgtgttatgtgacccacccctctcctggactaggaaggattagggcagtgagcttctgcacggtgagtctccagagtacttttcctttgaacctgctgctgaaattgaagcctctgaggataccaggagttgagttttcagggccatcttttcgttctcctcactaggaaggctgaaatgagtgtgcttgtgagtgcgtcaagggagtcgaattgagatagcaatagcaggctttgctcctgcttgaacctcaaatagtaaaaattaagaatatttataaaaataggtttttctcattccacaaaacagataagttattaaaattacattagcaaataatcctaacataaactcccaccatttttaagagagtgcttgataggaaaacttgtcaaacatgtcaattccatttctcatgcaaaaagtacttgttttctctgtcagtagcacagtgaaactgcgtggttaatgggaagaggaagagtttttgagacggctacataaatagaacataggacagatagatactaaaatagcttaaaaataatgtccctattgatttttttaatttgatggtttaaattcagtcacatttttgttaagtaccatttatgtactcagagctattttattaagaaacaacatgggccaggcgcggtggctcacgcctataatcccagcactttgggaggccgaggcaggcggatcacaaggtcaggagatcaagaccatcctggctaacacggtgaaaccccgtctctaccaaaaaaaatataaaaaaattagccgggcatggtggtgggcgcctgtagtcccagctactcaggaggctgaggcaggagaatgacatgaacccaggaggcagagcttgcagtgagctcagatctcgccactcgccactgcactccagcctgggcaacagagtgagactccatctcaaaaaaaaaaaaaaaagctaaaaaagaaaagaaacaacaaaactaattgcctgtggcaactgaggaatataaataagaaaattttatttaacttttcccccttaattttctcattacattagcttgaagaatttatagcccagttttttctttttgtgtatcctcaagtcctgaagtggccctgaagccactcagaaactggccccagttttttcccagaaacatgtattgtctgacttgtatttcctttgagtattgtccgcaagtccagaattactctgtctcagggaggatgggtctgttccaagaattgtatgtgctgcattggggggtgtccatattttcaagtcacagcgttgggtaataatatatgtacaaagccttacattaaaaaaaaaaaaaccttccaattaagagtttagttttcatgaagtaaattatagtgactttaatattttaataagctctctccctaaaaaaacttataacagcaattattctatcttatttctatttgacttaaaaagaagctaggagccaaaaataagcagggaatttaaagaattacaaaataatccttttaaagagtaaagaccttttagttataaagttgacaaacacttcaaaaactcaacatagaaaaacatcctttcattgttggtattcagaatggattgttctctctttagcatgttaaaagttctaaaattatctttaaggtctttttcttttttttttttttttttttttttttttttgataagcaccagccaagcagccttagtgggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggtaaaatttaaagcctgattctgaggccggcatcctttgggagaggaggccttcctcttccaaagcagcaggttgcctctttccggatattcagggattttgccatcttccgcgcctggccttcatcacgtgcagtatctgaattgtaattagcttttctggggagtaatggggcagaaaacactgcttccttggcctttaaagcatttgtgaaattcacggaggtgatatgtgctttgcatattttgtacgtctgcaaaaaagaggaattgctttggactgtaatttgaatttaagggaatttcagaggaaaatctgtttggaatctcacatcgataacactgaaaaacgtgatttttgctcgttgcataggatgtgagttgcttcacatccagcttttaggactatctttaagaaattatgtaaatagatagtcgcgattgataatcttggaaattttcaaaaatcagccagtatgcacttgatgtttaaagttgcacttgtgtgtctttccgaacttatttttactagtatgttgttttaaatggttggtaaataagcattaaagtatcaacatgcatcaaaaactccaaatagaaaaatcttagtaattcatattcatttgtatgctaatttgctactggagttatgaattaaacacttagacaatttcaaaagatcagctctagagtgtttagtaactccttggtaggacttggactgttgaggcaacatagaaagtatctttgttgaaaacagacagcaagaatgttctcagagaaattgctctttgcagcagcaggcagggctggtccaaatcttggagagttaatattgggatattactcaactgactgagtttagaatctctgagagaccaattctctaacttaacaatgcttcttccttgtgtgaggtcggttacctgagacaagcaagtgtttctcataaggtcagatttcacaatggtaaatatgtgcaggcaaaatagtacatttcacaagactcaaggcagtggtttctcagctaagtaacgtgtgcctatgaaatgtatttatatactttgtcttgcttaataactagaaatttgtacttacagatttatttcatagtattttcattttatggtacatttagggccatagatcctaaatattgagcgtcatgcttcacagtaattctttccacgagaaaggggtcagagatgctgagaaaaaaaccaacatgtcacttacacataatacagaacttgagggtaggggatgtcaagtatccatagagagcctaatctacacatggcatggctccaggtgattgaattactataataattaaaataactctctcttttccaagaatctatttatttttgaagggcaaactactataagattattccatatgtcttttcattaggttgaacataaaagcattgtttttgtaggttgaaaattggtcaaatatcagcaatttcatctggagagaaggggttatattagcattctacttcttccaaaggaagataaattgattttattttacatgagctgcaatatataacagtgtcattatgtgtttaatagttttgaagtatttattgcttattttcacaataaaattaagtgtattggttgggtaataatggtcaatagattttgcatctgcatgggattttatagtagaactacctacatgtgtatgttcttttgaagtgctctctctttatacatagctcagcaaaaacagaaacattaaccttgaagccaaatcttaatcccacttagaaaccttcattttagaacccagctggcaccacatgcaactagattcagaaaaggtgctttcttgaagtccttagcttgatgtttgtagtcactgatgatatctgcagttgaatggctttcggaaacttccccaccattttacaaggacttacttattttttaaggatgatattgcagtggttaaaagcaaatttcttagattagcatttttagtcagttgatagaattcatttgaaatattgattccttttctcccataaatgatgtatgccaagatttcttaatgggtagtccatgaatgggggcttcaggggccattcccctgaaaattgcatgcacatttttgtgcttttgtatagatgtacatcattgttgtcgtggttgttattgtcatcataattacagcaataatagccttctatgtgttctacctacccctgcccttgcccacactccatagtctattttcaacacagtttccaaaatgagcttttaaaactgaagacagatcatgtcccatatctcaaaaattttagtttatcatcctgctcagagtaaaaatccaagtcctaacagggctttatatcagctcgtccctgcttcctcttggactccgctcctacattcctgatttcctccactaccttcctaccatgctgggctggccctgcacctgctattccttctgcctggcatgcacccccacctcccctatccaccccctccccgccccactgtgtagggttgccagatttagcaaataacttacagcatttgggacatacactaaaatattgttcactgtttatctgaaattcacattcaaccaggcatctaatattttacatcttatagatatttaccttatattgtcgcctctacccccatccattactctctcactttctgcgagtctttgctcagatgtcacttctaggtgaagccttatctggatgtaatctgtaaacttccagctctccagttctatcccaatatttctttcttttttttttttttttttttttttttttgagatggagtctcactctgttgcccaggctggagtgcagtggcgcaatctcagtggcgcaatcaaactcagctgctgagttcaagcaattctcctacctcagtctcctgagtagctgggattacaggcgcccgccaccatgcccagctaatttttgcatttttactagagactggctttcaccatgttggccaagctggtctcgaacacctgacctcaggtgatctgcccgccttggcctcccaaagtgctgggattacaggcatgagcgcggcctatcccaatatttctatcatgcttctctaatttatttttatatttatttatcgccatttatcatagtacatattttacttatttgtctattttctggctccctcactcacttcatgagggcagggattttatctttgttctgtctgctttctcagtgcttagaataggtcctcaagtaatacagatggatatgtctactatttgtaaaattgactaacaaaaaaggcattgtaaggcagggcgtggtggctcacgcctgtaatcccaggactttgggaggccgagggctgcggatcacgaggtcaggagatcgagaccatcctggctaacacagtgaaaccccatctctactaaaaaaaatacaaaaaatcagccggccaaggtggcgggcacctgtagtcccagctactagggaggctgatgcaggagaatggtgtgaacccgggaggcagagcttgcagtgagctgagatcacgccactgcgctccagcctgggcgacagagcaagactctgtctcaaaaaaaaaaaaaaaaaaaaaaaagcattgtaaacattctatggcattttggtttcttgttttatgactttcagtcctactccttcccctcctcccaccatgaacctgcactgttttcattgtgtgtgagctggttatctatccccttgtttcttgttagttttctcatctgtgaaatggagactttcccagttaacttcctggcataagagttgccaggtcccctgccagaggctgcctttctgcataaacaagtcagttatcatgaattaagagcccccttcctcttgtgtcatttcttctgagcacatcaggggtttggtgaggattgttcagcggcccagggaaactgtgtctcacttcatttcccagttgtatcttgctaatatgtagaaatacaatggattcttacacattgcttttctaaatggatgatttgttttgaaaaagagagtttcgctgctaccaagagcctgaacacccctgtttgagcaagggcttgtatgcactgttctttgaacaacgtaaaccaaggaggaataaacagaaggaattctcctacagaatttttcatggttgtttgttttgtttttaaaactgctcacatcgtcgtcatcttcatatacttttcttccttacaggatttatgttagcaaagaggttactgaggcatgtgttgtcatttgtggtcttagccctgttaaaagatagagctatcgacctccattttccagtcttgggaggaagccaatctcttcaggaaagaaacttgcccacagcttcaggcctggcagccttcaagaggccacatttttctaaatggtttttgatagacagcttagaaatattgtaaacttgaaagcacaagtttaggtcgaagggtccattttgcttaaaagctcttaaatattttttccctctttcctggagtggggttttgggataagtgtgtatataaaaacaatgacatgctttcatacctttcttgccattgcttaaattcccttatgaccgccccagatatagatcacaccctgacattcttagctactgtgggaatggagacttgaagaagaaaaagtaaaatagtgtgtgaataacactcatctttttcctcccttgggagcataaagagtcccttcttcaaacacataccaggtcatgagaagcaccgtcagaaatctttaatgcttccctctgttccttaggatacatttcagactcctctgcatggccttcaaggcccgacatttgtttctgacccctaggcagaaatgcttctcgctccagaccctttactcctgccttcacagtgccatcagttcttagctgcaatgcctcaggctgagatgtctcctacccacacaccacctgctcccacccactgcaggctaatgcagctttcaaggctcaaatgccacctccttcaggaaacttttcccatttatttctcagtccagatttctccttctcagtacattttgtttttacttgtattagaacccatttacaactatttacatataggtctgtctcctccattagacgacaagcttcttctttttttttttttttttagatggagtcttgctccgttgcccaggctggtgtgctgtggcgcaatcttggctcactgtaacctccacctcccgggttccagcgattctcccaccttagcctcctgagtagctgagattacacgcgtccaccaccatgcccagctaattttctgtatttttagtagaaacgggttttcaccatgttggccagactggtctcaaacttctgaccttaggtgatctgcccaccttagcctcccaaagtgctgggatcacagtcgtgagccaccgcgcctggccgacaacaggcttcttgaagacaaggggccttctttaaattttcacaagtctctgccttatacacagagtatgtgttcaataaatgtttgttggattgaattgcactttatgcaattgttgatgttctgagtccctaggatcagggtttcccatcgtaaccccagagataagctcagatccatacgttgtaacaaggagttggtgaagctgacctcagaagtccatgtacctggcttctcagcctcttggccagttgcccgcactttaaacatctcatgtgccagaattgggggtgcagtgcaaggcacaaaataaatgaatgactgggatgcacagacattccagccttcccagagacaatgcattaagaaaatacctccatgcctacttcttcatccagagaattttcccaagatgaacctcatggtctgtccccaagtgctttgcaagtactcatctccaagctgcctttcttactataatgagttttgcaaagttttaatacatccgtctgccttatagagggataattttaccaccgcatggaataccgaagttttctgtggccaaatgtttcagcccaattgaggtatcatacccagcacataaaataaaagacaccctgtgttgctcttaagtgataaaactagggagtatatcagtttaagtagtatatcatgatattcttaaaattcttgttggagaaagtggtaaacagccttttatgcccagattctagtgggtcattaatggttaacaaaggaaagcaaatatattctatccctatcgacaccaggacaagtgaggactagtctctcaatcccttcttcctgtgattgagaaaacaaagtatcaaatttgagttcaagattccacccaatttaagcctggtttcttccacagcagggaaaaagatattagaatggaaaagggaatttcaaagcattttagtgctctatttgatggaggcttttaaatataagttcaatgagacaattttctgttttattctatagatttttttgatggggaattttttttctatagttaatagtgctgaagagtacttggtcttcattgttttgcctgtttaaagtataattattgtctgccttgttgagatatagttctgtttttccaaagagggagtaacctttgaaatcaataaaaaaattttggagataaatttatatgcattttttttttagctcagatgtctgaaaatctaatttatatgctttaccacaaaaggagcacaatgataagagccccacatggaaaaaaaaaattagcagggcttcattgtgggcctgatctgaaatagaaatttagtacaagcacatcatttctatttaaagtagcatttgggcctcaaacttcatgattcagacttcgagtgattttaagaagtacatatgtgaaacatattttaatccaaaggtctagtatttattcttggaaaggatggtggtgatggggggtgggaaggaaatggggcatctctatggaaaatatcacattgcattgatgcttgcttgaaagtagagacaccctattcatgcacatacataacgcacaaatatataaaatcttggggaactaatcacagttttacatacagaagcccaacattaatagagccctatcccattgaagtcatatcccattatttatttatattctctataacaagggaaagtttgaaatcttggtgtacttagtattcccctgtgcactatatagaagcatcagaaactaccaaacttcctgaaatagaaagtaatttgacaaaactgcttgaattcaaaagaaaacaaccatcagagaggcctaagtgacaatcagtgtaggaaagccattaatggggaaagaacacacagagaaacataatgaggacattaaaattggttccacttggaagctgtgcgatggtcatcagagtgaccacagttgagtttctcgtgcttggttttagttggacaggaagatttacaactatggcccacgatcttttagatgtaggaaaatgtgtgatactctgtctactcccagcactgccacctccccaccccacacttttaataccattattttaattttttaaaaatctatacagcaaagtcctttaaatggcctgcatattttcatggcttttctagctatcagaatactttaattgaaaagcaaaccaaatttagatgaactttgcacagaagaaaaaaattatttgaaaagaggttataaatctaatacatggaatatggatgttaaggccgaggagaaggcagtgggagatgaagggttaatcaggatgaaatcgagtttccatgtatgataggaaaatcttttgacagtgcataagtgatctcccagtaatgtggtcagtgttctcagagttaataatttccaccaatggctgataatgatcatttaaaagcattaactcacgtgagcaatgtgcctttcaattcagatcatggctcaacaggaaaccaaagctcttcatgctagtccttgaaattcagagcagggagtgggaagaggctttttcaacctcagggattctaagtgactgtgagtaggttttctaagggagagcgctagtatctgggcccatcttatgcatggacagttcattctagagagggcagcagcagaggaggtaccagagacaatccccatagaaggataggagtggctgtctccccatttgcaagctactggcaaaccatcaggcattacattcagctcaagtctctgccaaggtggtgttttattttgtgttttccattcctgtattcatttggaccacatggaagtgaaattaattacagtgttaatcccaagcatgtagtcaaggtcttgccaccctgcctggaaatgtggtttgaaatagagggataatggctgataatgattttttttttcaagttctagagcaacccttctacactttaaggtatattcaaaaatcctaggggtctctctttttttttaatgcaatttctgattcagtggttctggagtgggactggagggcttacatttctagaaagctcccagtgctgttgataatctgcttggagaacacactttgagtagcaaaactctagaaagtttcacagataagtgatgccacacataataggaaactctcagatattttaagctggcacaagctatcctgaaaacggtggcacagctccatctggaaagggtttgggctatgagcttatctacgtgctgagcttctttagggagggtgcacagtgatgtcaccaccactgagaactgccctcaactgcttgcattcatgtttcaggagcagatgttctatcacttgtctctgtatagtgcttattagagaacacttacgacaaaaaaggagctagcaggtagaggagtggaatggtcttttagtattctcagtactattccttgttgctgttgttttgttgggaaatttccatctcgaattttgaggtgcctctctccaaaagataatatattatcaatgtatgtgtatatacatgtgtatgtatatcattactatattactagtacacatatattaatctgtatgtatatatacataatcatgagagttcagtttttctcattttaattgtatatttaagcccactctgttaaaattaaagtaaaaagatactagtaatcaggcatatcattttatgtatcttacggagtcttgcagtctctaaattattataatttcatccatgttagctatcgattataggtttctaagtggactacgacattaacccagataagaatgaaattcatattgtagctgaaccccaagtgcagtggactgaggtctggaaatcagtacagtcatggagccaggagcagaatactgctttgctgctactgtgaaagagccatttgtatggtctttagagcttttcaagctgtagtctgcagagtgagtggggtctgcagggtcctagggcttcctttccacagagctttcctgagaggctgtgctggggctgggataataggagaatagagcatccaggtggggtgtggtagccctcctcattcaatcaaagcagacccttttttccttttgaacatatgtgagttccacagaagatttcagttgaaaagcactattaatgtttcctactgtggacagcatttagaggaaacattttaagcagcacgttcatatttcctctgttcacgtacttagtcaacagctcttcattgtgcgcttatcgtgtgcaaggcagtgttctacatgctatggggtaaacaagatgacaaatccctgtccccttagaaaagagcttgcaaccacagtggctgttggaaagaagcaacagtggtgctaaaagacaccaggtaaactggaaaggaaaattcatcatatagcgtactaggttctgacatcagtgaagtagcttccatttcatttcttgaggcttcatcagaagagatatgcgacaatacgtgctgggtgttccagatgtatgatctggaaaatgttgattcagctcttgatattgttatacagggagctgtattagtccattgttacactgctatatagaaatacctggccaggcatggtggcttacacctgtaatcccagcattttgggaggccaaggcgggtggatcacctgaggtcaggagttcgagaccatcctagccaacatggtgaagccccgtttctactaaaaatacgaaaattagctgggcgtggtggcgggcacctgtaatctcagctacttgagaggctgaaatcgaagaatcacttgaacctgggaggcagatgttgcagtgagccaagattgtgccactgcactccaggctggagattccatctcaaaaaaaaaaaaaaaaaaaaaaaaggaaatacgtgagactgggtaatttataaataaaagaggtttaattggctcatggttctgctggcagtacaggaagcatggtgggggaggcctcaggaaacttacaattacgacagaaggcaaaggggaagcaggcacatcttcacgtggccagagcaggaggaagggaaagagtggggaggtgctacacgcttttaaacaaccagatctcatgagaactcttatcaccagagcagcattagggggatggtgctaaaccattagaaaccacccccatggtccagtcacctcacaccaggccctacctccaacattggtgattacaatcgaacatgagattttggtggggacacagatccaaaccacatatctggagctctactagatttgtctgtgttgaactctaatctttaaaagctatgcttggatgggcgtggtgcttcacatctataatctcagtacttttggaggccaagataggaagatcacctgagcccaggagctcaagaccagcctgggcaacatagtgagatcccatccctacaaaaaattttttaaattatccaggcatagtggtgcactcctatagtccctatactatctagtcccagctattcagaaagctgaggtgggaggatcacttgagcctggaggtcaaggtggcagtgagccatgatcatgccattgcactccagcctgggcaacagagcaagaacctgtctaaataaataaataaaagctatacttgattattttattcagcacaattatttcttacagaggcagccagtgtgggatggttagagtgtgggccacagaggcagagagcccatattcatcttccttaacctcactgagctctttcattttgctgtaaaacacaattgatagtaatatctactccaaaagattattgagaggattaaagacatatgtaggaggaacatataaagtgcctggcacatagcaacccctccctcaataaagggtagctgttaatatatgccaggtaagaagatgcatgcttccttcattttaactaacctcctttggcaggatttaacatacacagggtccttcaaactagagcatactttaaccccaaagtcttagccttggtgaattctcctgtattttgagcacctgcacggggcactgggagcagcagtctgtggccagcattgccacagccccgggaagcattctgggctgcctgcatgcagacagtgggacccccatctggagtgagggtcctggggtttgaaggagagtaagacaagggagatctcttccagggaaaaccctgcccaaatgcaaatgtggttcatgagagacaacttgttattgtaacatctgacaaacatgcaattaattctttttggaactgaggtggggcaatgagaatggagtaaagggaagatttcactttggtttgggggctacagagggaagtatttgctttatagaagtagggctattataaactactttgaaacacatttatgccacaagtcttctacaaattgaatttttaaaaaatgtggagagaaataagtagacactgaaggtgagcatgtcagcagcagttcagatgccaaaaggttatcttgaatagcctttttgcttttagaactctgttcttaacagtattgtggttgcacaagaatctatattggaaaatttattgactagtatacttgctgctttttatctaagcttgtcagagtgtaagatggtgttgctaaatgaaggcttgccctttgaattcttttctgacctatttctcctgcaaacagtagctttattttttggaaataaacactgggcataatttttagtttatgacagtagtaagctgattctgatgagtgtgtgtttgtatgtgcacttctgcttgtctgcttcttgcaccaaaacatcctccagctgtgggccttttccctctctttagtaaagcctgtaaacaaaaccagaagccatgggaaaagtgtaaagagagcagcagaaaagaacgtttgcttttgtgaaaaagcccgccactgcttgaattttaaagaaaagttgatggatctttttctgttgcctatattaatagaacaaagcactgctcccagggcagaagggtccttctctgtgttggaagtgaatttcagtctcgtcctggagctcctaccagatgagacttttacatgagattttaagaaatgatcagttaaagggggaaaaaagcaaacatctgtgttacaggtcagcctttaaattatactgtttccgttttgtcatgggatacccagcttttaactcagtagtgaagtcggctgggctggaagttttcacatctatttttatcccacacaatctacccctggttcagattgctagtttcctcacagagctccagtccacactcggccctgaacgcggagttgaatcagctggctgaagctgagtgcctctcttttcctttcttgggaacaggaaaggtgctgtggagaggaattggggcgggatcattcaggggaaggtgacagcagatggtgggaaggccggagtcagcaagccaagtgtcaggggcagagtgagcctcagaaaacagcagctgcccggtgccagagcaaggaaaggccagggaggctgggcggggcagtgtctgtgggacagagtggggcaagaacacacacggccgggcacagcctcttagccagctctccatgtcagtatgagcagtaaccagggaactgggcaattggcacatcagcctatcagaattcatgggaggttatttcttaagtgaaattctaaagagttaaaggatgaatttggacagtgatggaatggatgacatcatcagtcaagaatcctcattggatatggaggggaattataaaaaggtaaggggggagagctcttttgtttataaacaattgaaccatttttctaactggagaaagatcacccttgaggagtggccaaattccacactcagtggctattgccataatatagtcaggaaaaactaaatgcacagaatcaaatgcattaagctaggaaagttctttctgcttttcccagcttatgttcattaatatgttacagcagcaactaaaacacacatgttgttattctgaagttgaaaaaattctattatgcatttaactgctaggcaggctttttatgtgaaggaattttttaaaaattattgacatatatttacagttcactggcaaaaaaaattactagaatgtttaacctatttttccaattttttgtttgattttattggcaatgaaaaatatcaagttttagttaacatgtttggggtttttaaaagttgatacagtatctgttcatcttttccctgcccttttttttgaaagtcagtaaatatattttgagaatgttttatatggtaatgttctggtaatcacaggcccgagtaaaaatagctttagttatatgggtgaggtcatgaaattaaactacaagtatatgcttatctgtccacagaagcctaaaacacacactatgtccttccctcttcattatttgccacaagtcaagtgtagttcacaacatggcataacatgaagaataaaatcccttccatcatgggcctggaaatgaagacctctttacctcagaggcaaatatcagttaatgatagaacagtaaaacttgctacttaatttttaatttgatcaaatacatcactaacttttttcccaggaatgacatatagaaagaagcttctgtcgtgatagatccttacgtatagtaatgtaaaatatggtagtttatatcttatatacatatatgtgtgtgtgtgagtgtggggactgttttaagtatatactgtacttcctagaggagttcacaacagcttatgttctttctccacaagctgaaacttaaatatgtgaaagcggtttcagtaacctgccatgttgccgtttgtgtttttcatcccttgtgatccccaagacaggaatgagcaccaaggtgatagttcgctgagtctcataaccctaacacttcccagctgtccgcttctgccggaagcgatgtgcaaaagatgcttgggacactctgccgtaagagtcagattgcttatccagctctgcagaacaagtgtagccatctcatacttctgctattttcagtgtcaaagaactggtcatggtgtcctttgtcagaccatttctcagatagaagaggataggtcagtttgcacttaggaaaaatgaaacataccattgctaatgcattaacaatgaagtcatgactgttctagttttttcctacttagaaacagagggaacccagatgcctggaataagtaagcagtgatacaccagcaacctgagacagggctgactaaagctacagacatgtacggctcaaggagctttaaaacatcaacaacaacaaaacagaattgcactgtgtaacccattatctaacaaaggcagtagaatgccgcatatgatttcagtatctgataggttagtacaaaaaaactgcaagatgaaacttctagatgtgtggagtgctcagagatcagttcattatgttccggatcttaaacatgagggttgttctcttgtcattccggccttttaaataccttcctcaggcaaagtgttttcaaatgtttatgtgtatcgtgattattatgaagacttcattataattatccttcttttttaaacccactctttgtaattttactatgagctagtgaaacagggcaacatacacttttttaaaaatatgaggaataagaaaatagttacctagtataaaaataactttccctaattagaatcttccttttctaattttttcgctaatatttttcctgttttgttggctaagtagaaaattaaattagatgccgtaaagtggggctctgcaggcttttttgaccttgcattcatcagtaagatggttttgagtccatgcctgtaatatacatatattttattcagaaatagcacccaccactataaaatacaatgtgtgtatgtaaaacatatacacaaatagatattttagagaataaaatgtttaaaatataaatataagtaaaagttgtaattttttttttatctcctgtggtactttcaccccattttgaggtcaattgtcaaaaacaattaaaaaattgatacatccctgcttaggtaccatagaattccctgaaccaattgcactaataaataccacatgtgtatagggattattttacagggttgttttaaagtcagacaaacagccttcagggggaaaggtcactttctgatgactaaaattagattccaccgaagcaaaggaagaaaaagattatgcttctgttctttttccgtggggaaggttttgactgtaagaaagatgtttcattaaggacctctggtttattcaatagtaatagtaaaactgccctcaacagaaaacatatcttagtgtttaagaagaaaagtgcagaccttagcagaatccgaggtgtatgtgttcagcccattatttccctgccctgctgtgagcaagttctgatcccctgataaagaaccacagagctgattgtcttcaggaccaacgtggtatgcagcatctaagtcagtgtcctcatccattccaccatcatttttccaagagccctctcatgttcctggcactgtgcatggctctaggatcaccaaagggggactgagctttccctccaggagctgaccgtcccaatgggggaggcacataaaggaacaaactacatggaactgatgctgcctggagtgtccagatagccggtgtggacttctaaagtgtgcagccatttagatctttccctgccccaggaatgtgtaccttaaacacgagagttgtttatgtgtacattcttggggcagggaaagatctaaatgacactaatggagagagagaaaaggaaatcgggaaaatttaatatagaatatggcagaagactggctccaactttgttccagagcagagaaaatgcagggaatctggtattgccttctgttcctaggctactgtgcacagaatcagggagctgacagcagggcggtgagtgggcccagggccgggccagccgctcgcttcgctttgttcctcaggggtgccgtctctagtgttgtgcatccaattatggtgaaagattagggaggaccctgtgaaaaaattaaaaggctggaaggaacaatatttaaagtgaagccacagctgcgcctcatgttttttttaaaaggtgaatggaaatgactgcttgagataaactgcaataaacaggaacacagaatgccagctgccattccagacaagctctctgccctccccacacaattactgaggaaaaacagccgtcgacctccattaaccctcacgtcttcctgcctgtgagggctgaatacgcttgaagaaccatgttaagttaccgaagcctgggacctagccccacctcagccacctgggaaaaatctcttccgctttgtgggccaggttctccttttcttaaaaagaaagaattagcctggtcggtcttagatgttataaatataaagcttcctggctcgtggttcaggtttcttatcatatcaccccattggcacacctcggttagccagcatggtcagggaatgggctgtttcaggtaactagaatttccggtgaaatgcaagtgtgttagatgtattcttgttctcacacacacatgcacacaaacgtgcacacacatgtccccttccatgtcatggtcatcttctacagcactctctacttggtctctttcccttctcctcgctagttgccttaggcttccagctctcctcattttcgtgtgtgtgtatggcttttttaaaaattgagatataattcacatacataaaagccacctttttaaagtgtacactttgatggtttttagtatattcataaggctgtgcacatcgtctaattccagaatttttcatcaacccaaaaagaaaccccgtacccatcaggagtcactcccaaatcctttcttctcttagcctctgacaaccgctaatttactttatgtatttataaatggacctgttccagacatttctggctccttttttctccctttctccattcttctcactaccttccccaccccttccttttaatattaataacagctaccactttataaatttctgtctgtgccaggcactgcgccaagcactttctatatagtatttcatttaattattaaaacaacctaaaaataggtattatttcttttttcaaaagaagaaactgaggctccaagagtctcagtaactcgtagtaatgtcagagtcaacatgttaagcagggtcttcttgactccaaatactcctccccaccttctttctggccatgagtctgtgtccacctcccccggatcctaggtccattctacacaggaggttgaggacaccagcttcctggctgctgattaaggcttggctgtttcataaccatgcagtaggtgtttgggactgttgtgttcctgtcagtgatactgaatgactgtgatgggtttccaggcttctaaaatggcacctgttaaaaatagagttgccagataacactgtcttgtgctaaaaagtattctctgggaggcaatcatttgagaagtagaatgagctcaggttcgttcccagctgtttgtgttttggatatggtgctcacaggggaggacaatcatttagttttccactgtatcccttgaggagttaacgttgaaacacctcctctaccgtagccatctttgtagattgcaccttagactccttcactttctgcaaggttcccattgtaagtggctactgaactttaaccctaggtgtttgttaaatacctttgcttaccttctcaatcgaaatattcaagtgttgtggactctgcgcagcggcatttctatctgcctgcttctgtttatgtcacttccctgtagcataagaaggaatgcagtcaacactaggcaaaaccatcctcacagttagttattataaatatatttatttataaatgcagttagttattaattgtaaataaatatctgcattttctgtactgacatcccagttcttttgatgtcagccaatactgaagtaaaataggtgtcagaagacacagggccccagagtccttccccttgggtgcccatcctgggctttagatatccgaggccagctctctcgtgggtacaggtcctgagcaatttacacccaaaggccttactgttgcccagcagcccaggctgacacttatttaaggaaacatgtttaggcaggttggtacgaggatgcaaagataagaaatttcaacagcatttcgggaaacctgtatttggcagctcatcttgacctttctggatgtttagtgtaagtgactgaaatggaaaatgtcacaaatacaaaatgaaaagaaagtgtcctgacttactatccgttcagtgatgcaattgaaagatactattttttaacttatatttacttccactaccaattaaaaagcacttctcaggggataaaataagattcaagaatttaaaataacctgcatggtgcaagaatttgtgcacctgacattcaacagcatacaatttcttttcttctagaatgctgtttttatattctggtctagtgacaaattcatggtttgtctcagtgagaaaataactagaaagtactattagtatatttgggttttcttttggccttttcatttcaaagaaaattaataacatttacataacaaacaagtaagttctatacttctggttcataatgtttaagagcttcagactcctcacactgtaatgctacctataaatgttagaataaagctgtcttataagctgggggaagaaataagagcgactaccactttcctaaaggaagagtacttttccacagagagcttcagaatcccagttacgttccctggcggatgctgctaatggtgatgatgccagatatcactaggcaatagattgcactgaagcaaggggatcattaattgcttcaaaacaagcatcctggtaaggccttggcagaggccaggctgctacaaatgaaatccacctggcttcagagtctggccatgccacatggaacagatgtgtgctcaattacagaagaaccaactctgtgtttcatctagctacttgatcttctcaatttgtttaaagctgtggttctcaaagtgcctatgctagcatcatcaacagcatctgggaacttgttagaaatgcacattctcacctccaccccagactttcttgaaacagaaaaatagactgtgtacttacaagccctccaggtaatcctcttgcacagtcaatcaagtttgagtgctattggcttaaagaaatgtgtgacagggtgtgtgtgtgtgtgtgtgcgtgtgtgtgtgtgtctgtctgtctgtctgtctgcgtgtgtgcacatgcatgctcctccctggtctccacttggccaaccagtgtctcagcaacccctggcatcctgagttcctttctgggccacgggggaccagtgtattcattagcttctgggatgatgcagcccataatccttaggaagttttttgtcaatggcatattgttttcctttttagcattggtggcaagtatttacttcattgctttaacaagcatttcctggggcctataggtaacaccagtgtaaaagacagagaaagagcagtcaagtcctgtgaggcttcttaaccttagagaagatctcctgcaaaacctctaaccttttgcaactcctggagcttattagaaatgcagagtctccggccctgtctttgatttagaacatgcatcttagcaagatcttgaggtgactcataagtaccctgaagcctgagaagcattgcaccaggtaacaacttagcagtgtgaaaaagaggatgctagacgtggtatctgtaggggtcattagtgaattagtactgagacagtgagcattataaaacaagtacatccgataatttttaaaagtctatttcagttcccatggcaaagagtgaaaagtgagaaacaaatgcatctgggaggaggggaagctcaatccagggaagaacagaaagacaggaaactgggggaaacacttttctttctcccactccttcccacaactgaatcttgtccaggcctacaactgtccctgctccaaatcttacatctgcttttattcccacttctgtgcctttctcatctactggatcccctgattccctaggccaggtttccttaaatccattcatcctcaggggagtttgagcagccccttcctcttggtctgacaggccctttccggctctgtgggtttcatcatctgtgcaggactcagaaggaagcagctgtttgttgtgtcctaagcaccagatggctttaggttcaggtttaggatgttatttcctgaagtgtgttcctgagaaccctagaggccccccagattttcccacaaaaaatatagtttgttaattaaatagattttgaaaatgcagaaaacacccaatcttccacttgtaaatttacgtgcagattagcatgctgaaggcttcttgcttcagagacaccacaatgctgctagtaaggtgggctgggccagaggcaggaaggcagaacctggggaggggatgcaggaatgatcttggtgtgtaagggatggggccatgccatatgccgaaaaaaagggtggaaaggtcctggggacatattagatttgaagatagatgatacctacccatgctgaacattttgctctttatttcattactgaatgcccctctttgttcttgtccagattggggaattgcagtagaacagggcacatcaggaaaggctgagcattggtgttcagagtctgcaagtgctcagtggtctgttctaagatcatggtggcttgcatggcatcattgaaagtcattgtgagcctcatctgctcaggcacagcgggtggcagtagggaatttagcaacagatgaggacaaaaacttcctggggctgaatagcggtgagtttctaatcacatttttactttcatctggggcttgaatagcttttctgcctgatagtgatgagccctgttcctcagttgccctttgtttttgctagcaatactaattttagatgttgtacttttgttttatgagggtatttcccaaggctgttttaggagtggacatggttctgcctgtcataagtgcagccagacagtggtgttttgagtcagcctcttccttttcctgtacccttgtctgtttctcaccctggagcgtattgggcttggctggattaagggggctggtggaagacatatttgccttgcaggtataattcctcagagaacaaaccgcccttgaaaccacacacacatatattttacacatgtgggcaactgaaagaaaattgggttctcattgttaaattttcagattgagtagtaatggtaaggagagtggtcctgatgggaagatatttgtattgtggatatttgtggttatgatttagcccatagtatgtatgctttgccagtgttttctctttttctgagaaaacatcacatccatctcagggaagaagtagacccataagtctttgtgccacattttatcctctgcatggtacccaccattattattagtctgaacaccttactctttaatgtggaaaagtgatgagaaaaagcagaaagatctggtattaggaagcatggacttggatcctactgctcctgcctaacagtatggtaacctttcatctccctcagtttcctcatattcaaagcagaaattgttggagtatgaactataatgctaccatctatcacagacttacattaccacaggtcaggtacagctgctaagtaatttacttaagttttctcatttaatcttccagcacctagtgagatcctttacctctggactgggaagagttttccaagcacaaaagccactgacagcatgacagatgaagcaagctattgacttaactacataacatttacagttgaaactcaaaaggacaaatactctactataaaatgtttaaaattctcagacctttgtaggaaaataagcaaagctaggaataagtaattcagagaaaagaaagtacagtcactaaaaacatttaaatatttactctcactagtaatcaaataaattgaaatttaaaaactactttttgcctatgaaattttttaaaaaacttttttttttaagtgaaaatgttcagtgttagccaggatgtagtgaaagctgcaccctcttacattgctggcgggcatgtggattggaacagcttttttcgagagcaatgtgacaaaatgtgtcaagagcctcaacaaatgttcacacttagctgatctgctaattccacttccaggaacttatcctgaggaaataatcagacatgtgggcaggcatttatgtaaagaggctaatttctggtcaggcatggtggctcacgcttgtaatcccagcactttgggaggctgaggcaggcggatcacgaggtcaagagattgagaccatcctggccaacatggtgaaaccctgtctctactaaaaatacaaaaattagctgagcgtagtggcgcgagcctgtagtcccagctactcaggaggctaaggcaggagaattgcttgaacctaggaggtgaatgttgcagtgagtcgaaatggtgccactgcactccagcctggtgacagagcgagactccatctcaccaaaaaaaaaaagaggctaacttccatgttatttttaatttgacacaactcaaatggctaaccatagaaggtaactccataggatggaatgatatgcaaccattaaagattgtgttttttttcctttctggctgctctggaggaaaaaattttaaaagattttaaaattgtgtttttaaataatttgaagggatacaagggcaattctgaaaatctaataaataatatgatctcaactttataaaaaggaaaataatgcacacatatgataaaaactaggaggaaatatactaaaatgttagcaatcatgtctctctaagtggtgggattatgagtgatgtttatattctttaagcttttcttgatttgttcagtggtatccagagacagagagagaaggagagggggaaagagagtgtattataaaacagtcctctttaaactgttagtgaagtatttgggtgtaaagaactgcaattaatgtaaatggaaatatttttaaggtctcctccaatatctgtagctctagtttatcaagaaagatagacatggaatcaagggtatattcacacattcataccctgggataagagttttctttaaagcctgtttcagaccctaggctaatgtcaggccagcatgttgttgaacattaatcattaaaattcatgttgctatctactgattttatatttggatattcagctatactcaacagttttctgcctgttgaggactttggtgagaatctcttttgtctgtgatatggattgagaaaaaggttcactgactgtacaaaatctgcctggcagatatggggatttgaaatgaacttgttttaaataaaggtgtcaagtgatgtgattctgttttggctggaccatcccaagtgccagccttgcatattcggaaaggtggtttgccctaattaaggttccaagcagtacagttgcaagtggttagtgaaataaaaggcattcttgcttccctccataaccttatggttactttcttaaagcttggttttgtgctagcccggcaaaaaataagaactatgaaagcagtctttcacatctgtaaaaaaaacaaaaaatctgtataaaagtagtctttcaccttatggctgtactacacacacacacacacacacacacacacacacacacacacacacatatgctagctcctagtatgatgcagtttcattgatacatgctaaaagggggtgctatatatatagacagagataatcactaagtgtgtacagtagaaagaatgcttatggtgtccaaggattaaaaagtgtgagagaaaaggagagtagagatgaggtttctttgaactagttctcaaacctgttgaaattaaatatctggcactagagcctggggcattctaatgcagcctgttgaagctggatcttgggaaccactgtcttagctgtactttgctgtcatgtattttattctgtgctgtctagtacagtatccactagccacctgtgatggttgagctcttgaaatgaggtagtgtgcccgaagagctgaatttttaatattaattaattaattcttaagttgaaatgcaaataaccacatgacactagtaactaccatattagacagagaagccttaacctattgtatactgtccttcacttgggaatgaaattattttcagtgcgcccttcccacaggctatgcatttttgtcattgtgacacagtgatgctccagaacctcctactgggagaatgaaggcatcaccaagcctttagtagccacacccagtcacatgacctgcattttgtaatatagtttgctcagtgtggtcttcaaccccttgctcagtgtataaaatggtacttctcaaagcctttgtcatctcacaaaactaaaatttcatccttagcccaggatttttgactcatgttgtttgttttttgtagtagtttcatttttaaccaaggaaatcatttttaatcttctcccctgttgtttaaagggtttaaaagttcagcatggtgagtttttatggggcgtttaatgagaagccaagcattgtaaacatatccaaatgatcacagtagtgtagtttaccaaatcctttttctatgcacactgacctgacctcccttcaaaatatgaaacagatgggcccaactagaattctccagctattccggacattattgtcaaggtttctcacattctaaaacctggtgagatgaggctagctcttgaatggaaacaacagtccccaacaagactgtaagctgcatggaggcaggtgctatgtctgtcttgtcctgggttctcttctggccttattgtggcatctgccagctcccagaggctgcatgttggtgaagtgaattactcttcttgccatagagaaaatgggctggctaaagggacgtgtaaagcagagagaagacaagatcagggaaagggcacatttgggatcaaagtgatttgattcaggagaaagtacttgccctccacaactttacctatacctagcaggtaagaagaagaaagattacgtgacaaataatctagttctatcctcgtgaaaatcatttagcaccacgatggtgattacttagactagagattagaatgagctctgaagaactgaaattcaagccagaagagactggtaaaatttcagcttttaataattcaaatactcttatgccgcagcctatttatttgtttttcatctaatgttacagttctaagaaacttagcaagttagactgcctgtggttgtgctatatctgcccacttatcagcattttttattttcttgaaattttaggcacagaaaaatgagagagagtctatcagacagaagttggcacttggaagcttctttgatgatggcccaggaatttataccagctgtagcaaaagtgggaagccaagcctttcctcccggtgagtgttcttttgagttgaatttctgatatgtacacagtggattctgtcacttgactattctaataaaaaaaagcctttaaatcttctgtagtttttttttccccctcgcataatactgccatctttatttgggttttagacagacccttccccacttgtttgtcggtttctttgttgttgttgttgttattattggctcatttcccagctacttgaggtcagatttttatattccattttttttctagccacaatactgattctgtacactgatagaggaatcaagccacactcctaagcaagctgacttatgattagagacatgtggcagactaccaaatttcccattaagcagtcccagatcacccagaatcacccccctgacacatttgattgcaataaatactcgtaactgagaaatacaattcccgctttgatcattcaatgtttattacagttcttaacctgtccttctggtggtttttctttatcttaatttatttcaggatatcattactctttatcataatttatttcagaatattattggtcatttgcgtagcttctaattccaagtaagatatttaaattataattttatccaaaaaacagtgctataggccagagtttctcgaactttaatgtgcttatgaatcatctggggattttgttaaaatgaagactctgattcagtagatctaggtggggctcaagatcctccatttctatgaagccccagctgtgatattcatgctgccattccataggctactttgattagtgaaagtatagacagtctgaaaaattaggcattacaaatacgggtattccaagtgatgaaagcatgtagaatgtttttactaagatgatagtaactgatcagcattctcatggtctcccctcactccccaaatgtctgtttcctctcagtcttccttttggctaaaagcaaatatactctgttaaaatactcagttattttaccatcttaagctaggcattggaaacaaattatagtatttatgcatccatttaaccaacatatttcttccatgtctgcatgtgaggcctggaactaggcatttttaaaatatctatctgtattccatatggctttcagtaaggtttgtactactatcttatcctgagagattctaaatcagcaaaaatcggaaagcagaaagcagacacatgctcacatatacacctatttgtgaggcactgcaggcagatcagtacatcaagacaagagtgccagtttcaccagacagtgttccagcatctcttcctctgctgggtgccagctctgtctcagaacattcccttgtgttcctacacatccctccagaactggatggtcagccctcctctttcccttaggagcacctctttcccctcccagtcagatgtggcagaaggcgctttggcctaggaacctggagatctgaggattagtcctagtacacttctaattttgaaactttaacaatttacttagttttaccatgtctcattttcttcatttttgtgaaatgagagcattggaccatatcatcttatagatctctgctactgctctctaatatttcccagagtgccaaaatgtcttcttttagaagcccaatctctctgttcagcaatgtcatatccatgttacaaatgagaggttttgattttgaaaatcagtgatttatatatatatatataaatcaatgatttatatatatataaatcaatgatttttatatatatacacacacatatacctatgtacatatacatatatatgggttatatataacatacgtatatattagctaatattaatctatatgtaacatacctatatataacccatatatatgtatatgtacataggtatatatggatgtatacatatatatatgtgtctttgtgtgtgtgtgtgtatatgtatactccagatatatttatattatccttgtgccactctccagaagaaataactttttactccttaactgtttcttctggtatttacctacatatctctaaataaaatgcttatcttcttagtttttattttaaccatcagactacctgctataaaaagatagtgatttagctctttttttacagccctcccaaagactgtcatctcttctattcttcctttagagtaatttcacaatttagagtcaaatagctatttaatgtttacattattaagattatgcattattcatcgcttctcagccttttagctaagatcaagtgtaaattatgcattattcccactgaaccacgtagtaaactatggttacttgagaaattttattttttgtcctgaaattagaattgcctcctttctccccatgttctgcatttgtattccagtgtgtgaatataccacaatttatttggcctctctcctgataatgggcattggattatttcaaaggttttgctcttgtaaacaatgctacgtataaacattcttgtatatgtcttctgctatacatatgcaagagtttctctttggggcatacctaggagtagaattactaggaaaatacatgattgtttacacttagaatataatgtcaaactgttttccaacatggttgcaacagattatactcctaccagcaatgtttcagagatcctgtggatccataacgttactaacatttgatattgccaattcttttaagtttttgtgaagattgaataggtataaaatgatttttattgtgtatattagccgtatttgttttctcttctgtgaaatatctgtttgggtcctatgccaaattgctgttggattctttatgcttttctcatcaacttatcgaagttcttcagtcatgatactaatccttaatacactgtatgtattgcatatatcatttcccaggttgtaacttatttttcacttttttaatatgtgttttatgaccagaagttctgaattttataggttgattttatactgaattttatcaaacttttctagtcaatggctttctgtatcttgtgtaagaaattttcttctcccccaagatccaatagacattcattagatttcctaccaagagtcgaaagtgttgagtttttaaaagtctgcaatcagtcaaaagttgatttcttgatatggtatggagaagtcaaatttgatcgttttccttatatatgaccatttttttatcatatttattggacaatccctcttttactcactgatcttatagactactcccatatatactgtatgttaatggaaatatattctattttattattgtttctatctcagcagcaaaactatagtgttaattacaatagcttcaaaataagtcctgatatctggacaggaaagtcctttttgttattctttttcttcagaagtatgctgcctgttacggctttttttattcctccacataaactttaaataatataatcaagttcaacaaaatactctcttggaattttgactgtaattgcattgattctatagaccaatttaggaagcattacattttctcattgtctttctatccatgaatatggtctgtctcccccttatttagatcttattaggtatttcttaataaggtttagacatattacacatctcttgttatatttatttctttcttaataaggtttagacatattacacatctcttgttatatttatttctagatacttgctattctgataaattctcttcagtaatgctttctcatttgctgctggtgaacagaaatgcaattaactttgtatactagtattatattcagccactttgttattactcctattacttctctactctcctattatttctaataaagttgtctgtagattccctgggatttttaaagaatgatatcatctacaaataatggcagctttatttattcattttcaattctcatgcttttggtttctttgtcttattggattggctaggtaccctaatacagtgaggattagaaatagtagtagttggaatccttagctaatttctcatattaaatgaaatgtttctactgttttcccatttcagatgatgttaattttatgtttcctttaatgattctctttatgagatgatgttccctcccaggtataacttacaaagaatttttatcatgaatgggtatttaactgtatcacatgctttttcttcatctgttgagttgaagaaaaagtacaatttcactctgttaatctattatatgaattaatgaattacatttatagattttcaaaatattaaaccatgctagcatacccagtctaaacctaaagtggttagggagtattatattttttcagatactgttggagtattatattttttcagatactaatattataaataaaatctgagtaaataattataaataaaattcatattttatttgtaacattttgtttaggattgttaggtttatattcatgattgacatgaatctattgtattcttttcttctgacatttttgcttggttttagtatcagggttatgctggcttaaaaatggattgggaagtattctctttcatattgtctaagaaaagtttacataatatttttatgatctgtttctataaagcttggtaggactcatttctctctgggcctggtgtttactttgtgtatttgctttaacgacagcttccatttcttaagtggttataatattatacatactttttatttcctcagatcagtctgatgagttatatttttctaggaatatgtccattttgtttgttttcaaaattgttggcatgatgttttctcatttctctgaaagtattaattttaattaagttgtttaaaatgttttcctgtccatcatgactttttctgagtttatttttcatttgttttgctttctgcccaccaataactaagtataagacactaaaagctgtttataaactgtggttggggctagttggcatgcatcatctgcttagagagcccttccctgaccaccctattaaaagtaaacgttctcgtacccatcactttgtccggtcttaccctgcttatcttcttaccctgatttgtttgttggggggggtgggggggggcttattataacctaacgttgtagtatatatactttgttctgtctttctctagctctaaaatataagctctaagagagcaagacttcgtctctattttgttcaccactgtaactattgcctaaaatagtatctaatacataatcactaaatatttgttgaataaatgaatggtgaacttcactatagaatggctgaataaggacacagctctttcattgggatgcatctaattgaaagtatctaggagtcttttctcttgggctatgaattgcgactgagagaaaccctccaacctcatcttgaggcattttaaacctggctgccaatgttttaagactctagcaggggaaagataggaactgtagcatataaaattttacttaatttccttgatttcagtaaagcatctctttgccacctcagctgtgcctgagcatgctccagtctcaacctcttaagacaataaatttcctgattctgccaggccacaggtggtcagggcagatagcagggcaagagggtcctttcaggtgttaaatcaatctttgtgttcggtcctacttcactcccctactttcagctgtatctgagcatttcgaggatcctgcagtagaaatgcatgtgcttcctctaccagcctcccctgtgggcacatggtagattgaggtagttaagtcaaatactccccacccatctgcatattatcttctaaaatttcatcaaaatcccttgtgtgctgttgtttccatttcctttttctttgtgcatatagatttgtaccttctttttttctttaatattattttagtaagatttcagaagtgagagtagatacttgtgcttaatatgccatggttaactagaaggttttcactgtttttaatagcacaaatatgttgattaaaaccctgtgtggaaacccagcttggcagtcctcctttggttcaggaggactgaaggagagagactggaatacctctgcccagaaaatgtgtcccccatcctaattgcccctttccatgcctgccctttggtacctctctccatccttcccctacaagcccctgaagcctacctgaaactcttctggcaaagcagaatttgaaaatcactgagtcatctgccccctgtggagacacggatatctaaacacaaatgtatttcacagtagctcataacaagctacacttgttgactcaccataaggaagattatttatatcctgttctttctgatactttcatctccacattctgggatgagatcatcttctgagaacacgatgactgtttgggatctctctcagaatgatggttaataatgagactacatatttctaagaaatatcactttatccctataaatttaaagtttgcaaagactgactgtcatcctcctcatcagtaataatgtaggagaaaagcctttagaatgttcagttgcaattgtgtaacccatactccctatccctgttagaatttgtttctgctgcatcactatccctgaaattcttcattgaactggaaataccttacctcttacttacaaaagtacttgagggatgtcagaacattgagttcaccagtatggtactccaaaatgtaccagagcacataatagtatttgaaaaaccattaggtaacttacagaaaagctatcattttttatgccctcctccaaggattacctctagtattctaaaatattacacaatttcaacgtgaaatagattttaagtggatcttttgaggagtaataagattaaaaccaggtaaacctgatatgaatttactactctgaagagctcaatgcccaattttaaatgaggctggagatttaaaattaattgaccaagcagtggattcctaaatgctaagcttactttttaaggcagggcctactgaggtgagtgggatctttggcaaactaatggagttctgtttatgtttctttaaaggctgtatatttgcctgtagaaactaactccatgcacagtatgtgagaaattatcaagtaacatgagggtctgggaagactggagtttcaactgttcctgtgagcgtgagttcctctcagttgtctgttgggttttagccccactggatttttctagatgttgctatctcctaaagcacttcttaagagtgacaagttgttaaatgaaagctaggcttacaataatcccataaagacatttcatgcctaatagtgcagcaaaataatatttgatgttgcttcataactcaactaattaaatttgacttatactgaaatgtggcaagtagagtgtcatttttttcttcaaaatttgctaatccacacattatcagccctttacaaactgaaactgtataacctttgtcattttttctatttaaaagtgtttccgtaaaaagttttttaaagcttaaaatgaaatgagaaaaatgaattatctatttttgaaataaggtttctaagaaatattagggttagtcatattcttgaagaaacattttttctattattactagtatgatactttcctataaaatatgttttcattggccaaactaattatcagttagcattatgtttcagatgatgagcttgtatagcttagtgtaattaaaggaatagaaacaggcttagctgctgtgggaacacaagatagtctttattaatagatatctgggaaatcttttattttttaaacattacaacctgacctaacattgtgaaggaagttttctctgccttctccttttaccttttctcagagtaaccacgaaataaatttgattctcacctctcttcttaccttaccccaagagagaacttatttacatacatatacatataaacacagtctttttcataaagtgtgcaatgggatgatgtgacctgaaataggctataccattttctccaaaggctgaatattatgaaaaacagaaattccccagagaacttttgagcagctgctttgaataatgattactgtttacttaactcaaccattccaacatcacccaatcaaaactcatttctttcttggccttataggtttattggtaaatggctgagacaaggccaataatggacacctgccatctccttttgtgtttgggctggagggcaaggagtggggggcaccctaactgggagctgttatcaactggaccaataacagtgaatccagagagacttcaaagaaataggattcacagggactttaaaagtgaggaactgagaatctgtatatacaatgtgccacgaatcacaggtcgaaccagcatcattttgccaagaaagtcaatcatccttttgtctctaacagtaataattgttgtatgattttctggaagaagtaagcacaacggttatatctgcccagcgttaatgaggaaagaggttgtctagttccaactcagtgaaattgcctgtctgtggcatctttcttgaaataatagatgcatactgtagcaacctatttataacatgcaacatatctttaacatttcatattagtctcatacatatatactaaagatttgctttaaaaacccttcatataagtatttccaaggtgtgtgtcattgcaaatggtagctaatgatgacttcttttttttcactatttgaaaggccactgggtagtctaaaaaaaaaaaaaacaaaaactatcattttttatgcccctcctctaaggattgcttccagtattcaaaaatattacacaatttcaaaagtgaagcaagatttgaagtagatcttttgaggagtaataagattaaaatggcaaaacaaatctaattatgtaagcaattcttctccttcacaaacctgaaagaaaagcaaattggtatttgtgaaattttctttgtctaataaatagtctcactttacaataacaccaatgaccctggtttaattaggtgcaattaattttatgcaagctgaatttgacatcttgctagaggcataaccagctgtaccctgtcttatgaatttttttttatcaccaatgagaattcaattgcctgagctattgcaaaagagggggaggcaggaagaaaaagaccacagggctgcattttatatttaaaaatggctctagtagacagctgaatgtttaattaaaagagtttctaggaattatttttcattggtgcatcatctttgacaagctatgatgactttattactgtagtttgcattctctttggacagtggtcctatacatgtgtctagacacacacagttcacgtgacagtgctccattgagagtgcacaaaagcattcattgctgctagaaaacattctaactgactgcaggtgagccatgttatctaaggtttaacaccatccttttactcaatcctgttgtaaaattttctgtcctgcttggattgttctcattcagattattgcacgcattaaaaacccatggaaagccaggcacagtggcatgtgcctgtagtcacagctactcaggaggctgagatgggaggatcccttgagcccaggagcttgaggatagcttaggcaacacagcgagaacctgtctctagaacaaaacaaaacaaaacaaaccatgaaagagatttctgatgagaacagaaaccattagtgcaatcaacagattacaaagaggaaaacaagatccaatggctataatttgtgaagtgttttctaagtagacagaatatttatgtatggcattagaaaatcagtgtcattgaaaacactataaaaagctcagatcctgccatatttgtcccccattcttccagtctccctgcttctgtcaccagagacaatcactgttccaggatttgtatttgttcttccaccatcgatcatgaggtggtgtatccacatgctctgttaatcaccatgctttttcacttatcaacatgtttcgggtctgttcactaggcaggcagtgtagcgtggtgggtaggagcggggtattgggaaccagagggtctggcttggaatcttgactctgccgcttactagcacttactaatggcttcacttgtggctcagtttcctcatctgtaaaatagggtaataattgtgcctacttcatggggttactgtgaggaagaccagcaaagcactcagaagagtgcctggacgagagtcagtgctgcattagtaggtgctgctacagtatttcgttatcctttttatttactcttagacaccattgattgtaagacaaatagttattttatgtaccactaaaaaagaaaaactactgccatttaaacggtgacacatgccttcttaacacttagagtttttattttagttattgaaagagtaattttagacttgtttggacatacgcttttatcatatgtttcttgtgcacaaaaagaggaagaaaaggtgaaacatgttggcaaatgtagtcctaaactttccagctctccacttaaccactttacctgagagctgccatgtctcagcttttgggccatcgggagatggagtgcatcaccttccaagccatcgtccccccatctgcaaggtttgatgctggagctttgttgttcttgtcagaaggcatgagtggacaaccagtgcccacctcctccttggggattattacctggtttgtgggctgatagagttaagtactgcaatcatgccaccacctacctgaggtacagcagctgagatacatccctattttaggctgggagcagtggctcacgcctgtaatcccagcactttaggaggccaaggcaggtggatcacctgaggtcaggagttcaagatcagcacagccaacatgatgaaacccccatctctactaaaaatacaaaaattagccaggagtggtggcgggcgcctataatcccagctactcaggaggctgaggcaggagaatcgctttaaccctggaggcagaggttgcagtgagccgagatcaccccattgcactccagcctgggtgacaagagcgaaactctgtttcaaagaataaaaaataaagactgcaaaatgtaaataaccatgcttcatagaatcaatgcaatcttattgatccactgcattctttttcacgactgcgtagaattcaaacagtcacaaactaaatcatgaaagccagtgtttttgagatgaagcttaccatggaaccaagcctaaatggtggccccaaaatgtttctaaacatgaacataaaaagtggtaaagcagtgctttaatggtcaaaagaataaaagaatttgcaattaagattttcgcctacttcaggaatatgcctcagaaacacacacaggcactgactctccgctgtcatgttttttacccagtccgcatgaacattttcaaaggtctggaaggggaaaagtatttcttctctaaccttcattgcctcaacagctgaaactcatcagcaggtggggtagataggtgtttaaactctgtctgagctgagcagaataaataggcagcctggctttaaaaatacaaacagttaaatttatatcaattacgttagagtctgtaatttactgcagatccaaggaggagaatgaaatcaagactggattgaggagggatgtcaacagttgaatcagagtccatccacagaaatgttctcttataagaaaatatgtttcttgctgcccacggatctcccaccacctccagcaccctgccaaaaacaaaagtccctgcatagacatggctgagtcagacacacagccatcctcttccagccatcaaacactgatctgctcaccttttctccaacacacaaatgctaatcatcaactcggtcatgttctttccttttcttttttaaattcttgccaaggccgggcgcagtgactcatgcctgtaatcccagcactttgggaggccaaggcaggtggatcacatgaggtcagtagttcgggaccagcctggccaacatggtgaaaccctgtctctactaaaaatgcaaaagatagctggctgggtatggtggcgggtgcttgtagtccaagctactcgggaggctgaggcaggagtatcgcttgaacccaggaggcggaggttgcagtgagccaagattgcacccctgcactccagcctgggcaacagagtgagactctgtctcaaaaaaataaaaataggccgggcgcggtggctcacgcctgtaatcccagcactttgggaggccgaggcgggcgaatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaataaaataaaataaaaaaataaaaaaataaaaaataaaaaataaataaaaataaataaattcctgccaaatgcccatatgtagcacctcagaggtgctcaaaagaggaaaatccaaagccaactgaaactctttcaccaaaaaaaaaaaagatgtatttcctgactttttttctatgcatatatctccatatttttgtttataaaattggaattatagcataggtactgtttttagccttctttcttttacttaacagtcggaaactttcatccaatctaataatattggactaagcttactcataagattcatctaatgtaataatattggactaatcttattcataagattagtatttctactagctgcagaatagcccatcatatatttcaccataatatactttatcaatcttttattattaggcatttaagttgttgccagctttttgttttggttttgtttttgttttgctttctttcttttttttttctttcttctctttttttctaccattaatgaatttgtttcctcctttttaaagtgctctgacatctcaagacggactttcctaaagtatcagtgttgtgatattgtgtaatttaacctctctgagccgttttctcatatgtgaaacagggttcacagtgcctgcttcatgtgtatctgagggttagacataaaatagtaaaatgcctggcacttagtagatgctcaaaaacagtaacttttaatttcagaatacagattacttggaaattacttggccttatttaacatggaagtagataacatttgctgcctacgagagatggctgttttattcctcgtatcagaagaggcctcgttctggtctttcattcatgctagagaacatttcagttgaaaatgcattttcccaacattaagatcctataattccaaatttaattacatgaaagtggtcattagtgaaggaaatggacactgatgtagaattagaaccaacagccgtctgaggaatgcaagtatttatagctctctggagattcgggttaggatacaggggcgatgtttctccaaagaaaagctggtgagtgatagtttcccttttctattagttgcctaagtcagtgaggagattctgtggctatgtggtgccacagaatggccggtgtgcttaccagccatcatgtgaacatgtacagatggaagggtccagaactagtcttagaagagcaagcagaaaaaagaaagtatgcataagattaggaggagaaaacccagagagggtcattcacactccaactacctttggagctgccttcatcagcttctgctgaggaagccgaacacctgagtcctgtaaggtggggatcaggacaggatataaagagacataatgtcctccccagtcctctctttggcatatagttggaaactacccataacttctctgggcacataactactggagggtcagcttttctatctctctcctgtatttattccgcccaacctcagttcaccaagacctccttccttttgcagttttctgctctttcactcttctggttaacaccttattaatgtccaggtagcaaaagtattttccatatataagacagggagattctactaagtgtttcttgaggtcccttccaatgctctgtgtattccacatttctatttatacattgtgacttaatgatccaagcacttgatatctgttagaagacctagtttttatttgcatcacttaatgtaggggtcgtgaaccataaaatgccctcaggagccaaaaagaaacataagtgagtgaagtagtgcagataaaaagcaatagagaatactggggactgcagcaaactagaaagtgtgtgccctggctgacggggacagcagctactcagcaccagcctattggtgccatgaaatttacagaactattattgcctgatcatcaatgaatgaatgaatgaatgaatgtgtgcatgaacatgtaactcttttttctctaccttatgtagttataaaaatcatttatagtcattgtgtgtgtgtgatgatttttgttggaccagcattatttgctaaaatatagcattgtattttcataacaaatattgtgaggcagaaacttttccttttgtttctttttttgtgtttttaagtagtaataggcatttctgtaactcaaggtaaatatcaaactggaacagtcagtagggaaaagaagggaaaggagcagagtttgccggatgggaaaactattttacaatttacaaggagtagcagtacttcattttaacctaactgaacacattttatagcgacaccatcacacgtgcagtacatctaaagcttacccaaacctcaattgttctcacattgtttcttcatgacagattctcagaaaaatgaaatgtgtttttagatacttgagtagttacaatccatattttatgtttcatcacttttgaaattctcatgaaacagaaaaagatatagtataaaaatataggcaattattcattatatataaaatctttgaatcatgcatcaaagatcctttaaaataaatggaaataatgtattttaatgacccagccacaaactagttggggatattgagtaatgaatggcatagcaggaccaatggctctcgagccacactggttgtaggcagataatgagcaatgcatgttcgaagtccctggcatatgggacattccctttcattctgtttcctaaggaaagccatacaattgccttaaaattataagcaagtataggaggcatatttcctttaaaattatattgccagatacagaaaggatctaataaattcaaacctcatgttaagtgtagtataagggaaaggccactggattctaaaatcagaagtccagcctgtagcctcttgcttcgtgaccctgtaccagttacctattgccacaatgatgatgcgtaatttttttaaaaagccatccacgtcagtagcatacgatgatgaagttttgcttctccttaggatcctataggtcagctgggtggttctgttctgagctgggcttggacaggcttattcagtcatctccggtcagcgaggtggctgggctctcacacgtgtctagggcttcagttgagacaactgccggttgagctctgtgctacgaagttacaccgccagcaggctagcctggacctgttctgagggtggtggcagggctccctgagggggaaactggaataccatcacttcctctgcattctactggcaaagacaagttccaaggccagcccagggctagggaaatagactccacttctcaatgggagaagctgcagggtcacattacagaggagatgggtataaggagaggaagaattgagatcatttttataaagaggttgtcacaggtctgtggcaagtcatttgacttctctgagtaactatatcttgcctgtaatccacaggtgattatacagccccgggagagaatgtaagtgaacatactttaaaattcaatgcaacagttcaagtaaagtgaaccaaagtgctgtggacagggggataaaaatcttaccaatgaatcttgaacatttatacgtagatactagtggtctaagcaggtgctgggagattcccattcctaaaatcaagtagaaaagcaagtagaaaatcaagaaaaaagcaagtagttccaggcttcagagctggcctcagaccagcccaatcccggtcactacaacccaaagccaagaacaaaggcccaattcataatgaccactgctcctctagaagtcaccagcaaactttagggccatgacattgtttctctcagggaataaactgctcttgtccctgtattttgaaagaaatgttacctttatataaaatcatattaccacttggctgagtttttgagatattctattcatacttaaaaacttttcgtctctgccatcctctcaactcctgtgcatattttaatagtatccctggtaacagtagttggaagtcagcaccagtgttttctaaataacagccttcctcactataaatgccaagcagacgtggttgctgtgcagcctcccgaccaagtgccctcctgctcctggccagtaggcactgtcacactgaggccactcctgctcacactgagatgtccagaagacatacttagtctttatctctccatgtttccgggcattctccgtcaaggacactttctttccagacccctggtgctccctgccagtagctccgggcagcagcgttgtttttaattgccttgtggtgtgtaagggagaagagctttctgggataaccaagacagacctttcagaaatgaaatcgacaggcaaggctgacttccagcagcctttgtacagtgctctgctaaatgccacttgaaacatcaagtaaccttgaattggataccttgaaattatatctctaattaacaagatgaggatcgtgttctgttttcacctcagactgtgcttgagagatctaggtaaattaggcaccctgcagcctgaattttgcaagactggttatgagggcagccagatgcactgcagtgtgagggacagaggcccggggaactgtggttttcagatgtgagcctcaagaacagccatgtctcccagggtgggcagggtcctggaacaggggttatctgttcttccaccctgggcacagaggccttcagcagcaccaggtggccccactcatccattcaggctgcttgggagctgtggttgagtttcaccgagagctgacttcatcttaaaacccgcttaaaggctaaaagcaaacaaatccttcttgaaacctgagctcgttttaagatgtctttactaaaatcccctctgaaccattagctgttatgtcatataatttccttttcctgagagtaacattcttggtgattaccactataaggaattatgtctcaccctataagaagctctcttcagtttcctatggggataatgtggtactaaggcgattttctgaatttctacctgcggcgttttttgattttacgcagactactaaatctcccccaacttttttttttctttcctttcctgagttagactatatgggatgtttaagtctgggttaatccttcaaaaagaagtcagcgtggccgcagaacaacagaatttatgatcagactttcttctgagtgaaaatacatatatctggacattgtaaactttattttgctttgtgttttgtattgcgggttattttacatttttataatctgtgtatccagtagccagacccttcttctcaagactttattcaataaatagaaaatgctacataatcctagattcaaattagggtttgtctttaaaatgtgtctgtttttaatttgctaacagcttttttcccaccatcttccaatccatagaacttgagtattattattaaaagggggttgattttatttttttagaccgacagacattaaaatttctaaacctgcatggaatcaaagggtaacctgaacatattagatttctccaggaaaaaaatatatatgtgtgtctgtgtctgtgtgtgtgtgtgtgtgtgtgtgtgtgtgtgtgtgtgtgtttatgtatgtatgtatatccaatggataaaagtaaaaaggtggcaaatcccagctcagtagaagaacaaactgcctaatagaccatgtgttgtctcagagagttgattctacatcagggattattgtgacaggacaagcagtattagagtaagtgactttagagagtcatttcacctctaaaattctgttccttttgtttagactttcagtaaatagagaatggagagcaactcacatgtacaggtcacttgccctgcactaagctctgaatgaactattttaatccttcctgcataacactgggtttgctactattcaacccattttatcgatgaggaaaactgagggtcatagagcttttgtaatgtgcctggagaaagaagtaaggattcagaacctaagttcagctcactccaagcatcttcagatgatcagagtggggtgtgttgctttctaacccctagttctgggcctggctcccccttgcctgtgccatgagggtagggagcaaatagagctgggcagattgagggaatggctgcattttcttacaggggttgtaagctgggattttcagtaattacagaatttaacaataggtggcagtgcatacccataacaattatggttcccgtgttaaatcagattttctttttctgggttctgtgttgttttcaataaaagaatcactttaaatgagtgatctgatcaatttctacaaagcattcctaccattggaattgaaaagtcaaatctcaggtaagttgttcttggcatttcttcctatggcagtaataatgccagagaaattcagcatcctctgccctaaacctggcttaggtcagcttccttgggatcttttcttgcgtaggaacctccttttgccttttctttccctaagcttacacagagactggggctactagagatgctaggaaaactacttctttaaaaatgctttatcaccaaacagtattgaaatgtgttcaacttcaaaagaaggttagaacaaaaagttggctgtgcagcctggcctgcgagtggcagctacacggccaggttaccctttgtgactgtgcttccaaaaacatcagccctggagcttcaggattcaccacacatataatggcttcccaaaggtctctgtccctgaggttctgtgtgcaggaggtggtctgcagaaccttgctgtgttctaaggctgcaccttactgcctgggtttggggcttccttacatttttttaagtgtgaacctgtggtgttttccttccttaatgatataaatgagctcccttggttggcttttggcaactgccttaaagatttccttcagatgaccctattctgtctatttgggagaaaaggagtctttcttcagagagctgtggccttgggatgctggctccagtgagagagtctttgattgtccccctgggacgggttctctagatgacaccacgcagccttatttgcccgaggaccccattcatcttgattgacaggactgtaaactcaaagactcaacacatttttattgtgcaccaactatctgtttggtattgtgctgggtgctctaacatggggccttaaattatttttcacttaccatgaaactggcgaggaaaaaactcacagaacattggaaaatcctctactaagagttatttatatgtggagagtaatattggttgctcatttctccatgtgaagaacacataagactactttctgttagcaaaatcagacagttctattggctgaagccaaataacaaacagctaagtagaactagtgtcctgtttgtttctgcccagactgcagagtgggatgaacttgcagatatgctttgtcaacgacagtggcagtgataaggacagtgatgctgatgacagtaagactgaaaccagcttggacacccccttgtctcccatggtgagtccaaacagcaccagctgaagctcggtgttgtgatttccgggccatttagcttcttttctgttgtaaggtgaatcaggaacaaacatttcagagattaaagaagaaaagtttcttggaattgcatgctcctaaaatttgacaatgattaaaaagtcaaagttgtaataaaatagagatatataagctttcttaaagttaataactattttcatattaaaccattagagaaatcaccagcctgggcaacatggcaaaaccctgtctctataaaaaaatacaaacattagctgatcatggtgcctatagtcccagctactcaggaggctgaggcgggaggatcagctgagcccaggagttcaaggctgcagtgagctatgatgacacctctgcactccagccggggcaacatagtgagaccctgtctctaacgagagagagtgtattagttcattttcatgttgccgataaagacatatccaagactgggcaatttacaaaagaaagaggtttaatggacttacagttccacatggctaatgaggccttgcaatcatggcggaaggcaaggaggagcaagtcacgtcttacatttttaaaaccatcatatctggtgagactcattcactatcacaagaacagtacaggaaagacccacccccataattcaattacctcccactgggttcctgccacgacacatgggaattgtgggagttacaattcaggatgagatttgggtgggtacacagccaaaccatatcagagagagagagagaaattagatatgctctaaaaattataaagagaaaataagctaaatccagttcttccctattgggcttagaaatattagctcatgtctttccttcccattacagaagttggctgaataatcatgggtgcctgttgctggaattctttcctctctgtgaggtctgtctatagccttttttaccaaagaccaacaaagaggaaactgttgtcgttgagtgcagtgcgacatcagaacatcactggatacatgagatcctgtccacgcaaagaacctacgtagggccttggcttcgagtcaatattttgttatgtctgttcacttcaggaaagttttgaggccaagaatcaaagacatatttcaaggttgttgtaaatatatttcccattattaactatactgctctctctgtttatgctaaaatctattttaaactagaccctttttctgttacttgagatttatcaactcaagtagcaagtcacattgagggagggaactctgagctgctctgagagaaggctcagaggatgttgtagcccatctctaagtggatgctagctggcatgcatggaaggctcaggctgctctttttccctttgcagagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttgtaagcagcaaaggctgaaatgcaaggaagtgtttgggagccagaaatggttgacactgtcccagtcctttcccagaattatgcaaacttgtgtttctctaaggcggtttgtaaaaagtcctgtcattgagaaatgattaagtttgtttctttttccttcctactgtaggactgaaaaatacagaagcaatagatttcacaaaagtaaagtttgctgttgattgatgtctactgtttcttagcaacaatattagctgccacgggaatatttaaattcctttgaagcgatctcaatctaagaacctattggtcttggcaaacttactattgctataattgtcattctcatatttcaataaagacaatatcacatagtgaataggagtcctggactttggagtttaagtctagctctgccattgacctgctatgaagttctaagcaagttacttaagtctcagttttctcatctataaaatggggatgataatgcctgtgtcagagtatgattgtgaggattcagtgagataaagtattcaaagcacatagcacagtgcttgtagcatggtataaattattaaatagtagctgatactaattttttccatgtcattgatattattgatgttccttgataattcatttgtggctataacattgactcacaacccatattaaagacgagtcaaaaagcttttgatgctggtagtgttgtgttttgatgccagttgcatattaggtaatgtagtgtggatgtagggccccacattgggaaagacacagactgggaaagcttttaatcactgaattgcagtgggtgggtgagtgggtcttttaagagaaaactgggtcttaacgttcagtgtgtttgtggctctgttcactcctccatttcttctcctttgtatcttcagctgccacacatgcctcatataagtgaatgcttgatgaaaagaagtttaaaacccaccgacctgagagacatgactattgggcagctacaagtgatagtcaatgatctccattcccagatagaaagtaagtgtaagatatgcttgaaaataggatattcaatgtaaaacattatgggataatgctgcttccttggtccaactttttcatacaacatttcattgggttcctgtgtgattgcaaggaaaataagagaatcacaaggctcttttttgttgctgttgttttagctgtaaaatgttcagaagctttaagaatttttcaagattcacaatagttataggtcccttctatttattttaaatccccagctcctagcacagtgcatgtacctgacttacaacacctgtttctggaacacagttcagtagttacaagtcatttgctatacaagtatactttctactttagttgtatacacattcatcgtaggtatcatcatcatcaataaaatcaaattagacacatttcctaggactccaggtggtggagtatgtggaaccaatatgtgaaaattacagggtgacaaaatacagacttttcttcccagaataaagaaagacctctaacagaagtggccacagggagtggtgagtggtgctcactcaaggtgattggtcatgcagagaataggcagttagttgcttgtcctgatgaaagagagaacattctcacttaggcagtgtggttaagccgataaattcacaatctcttcagctcctgggaggaatgagtctgtataattatacggtattacagattaaaagaaattcaagagatatgccaaacaaatgcattcaaaccaactataaaaagaaaagagcatttatgagccaaacagggaaatgtgaatactaactgaatgttttagtaaggattgatttattttaggtgtgataaaggtgttgcagttatgtgaatttaaaaaagaaaagctggccgggcgcggtggctcatgcctgtgatcccagcactttgggaggccgaggtgggcagatcacgaggtcaggagatcgagaccatcctggctaacatggtgaaaccccatctctattaaaaatacaaaaaattagctgggcatggtggtgggcacctgtagtccagctactcgggaggctgaggcaggagaatggcgtgaacccgggaggcggagcttgcagtgagccgagatctcgccactgcactccagcctgggtgacagagcgagacaccatctcaaaaaaaaaaaaagaaagaaagaaaagaaaagcctctgtcttttagagatacctactgaagcatttacagataaaataatgtgatagctggaatttgctttaaaataatccagtagaagtcggagagagaaatgattcaagcttggccatgagttgataattgttgaagctagttggatacatggaaattcattaaactgttttctctgcttttgtagcagtttgaaaattttccataataaaaagcttaaaacttcatattggaaaaacaattctatgcattaagggttcagatatgtagacactctactaagtgacagtataaaaggctacacaagagcacactggaaaaaatgaaatttttccacaagatccaaataaaaaaaattggacatattcagtgccaagttaacacattgaatattgttttaaaattaagagaaagggtcaaacattttgattaagaaaccatagattcacaggattttttaaaaaaattctacaactgcattttaattttagttgaaaattaattactagagttgctattctttcaaggactaaaagcactttctgatattttaccactaaaacatcttccttagacttttaaacactgaaattgccatctagtccttttcaggaatagatgaaattttagacctctttgtgtgatttttttttttggggggctctctttttaaaaatggaaactagtttgacctaaaggcagataaatgcatcatttgaagtcaggatatctaaaagcatttccaagggggacctgtctgatcacccccattctatcttttgtttccctgcccagagctcttgctaaatgggtactctcttccatgtgtctgggcctagcagctgtaatgcttagcttctctgagggaaaaagcaagagagagcctttgcttgttcatgtttttcagtggcaggagcccaattaacccagtgcactgatttcaggaagattagatatatttcgggcccaggtgcagtggctcacacctgtaatcccagcactttgggaggccgaggcgggcagatcacgaggtcaggagatcaagaccatcctggctaacaaggcaaaaccctgtctctactaaaaatacaaaaaattagccaggcttggtggcacatgcccgtagttccagctactcggaaggctgaggcagtagaatcactcgaacccgggaggtggaggttgcaatgagccgagatcgtgccactgcactccagcctgggcggcagagtgagattccgtttcaaaaaaagaaaaaggaaggaaggaagggagggagggaggaagggagcgagggagggagggaagaaagatttctgtctctatagatttcattcctggtataagtcttaagtaatattttccttggcaccctgttgtttagaaatttcaggggttatttcttcaggtcttgcacatctaactatattacaaatctgactttccaatatcttcagataatactttctcctaaaacaatctgcacatagggcttctcctttcctagggccatgtgaaggcattgagcatccctgacataccttccttttcagctgggcatctaatgtagtagtcaggctccgaggggcccctcctgactgtcagcgtggcaggagcaccctgaagctgaagggtggaaaacttaatgtgctccaggctttgctgttcacattttttcttcaaaacaaaacctgctttttctaacaagctgttctcctaacagctaacaatttcttttcccaccttaatatgaaggtaattggaaatagttcgtactttactccttttcttcccacacctctataattatgcaaactagacacgtttctgcaacatacgatgtctaaccttttacaaaaatatctttcctattatgggtagctgtttgtgtgtatactggttggtaactagtttacattctgacttggaggcagttttatctgtttttaaatgttctgttatttgccacaggcttgaatgaagagttggtccagctgcttctcatccgagatgagctgcacacagagcaggatgccatgctggtggacattgaagacttgaccaggtcagtgtggcttcactcttgccaaagaagaaaagcccagggtggtctgaaatctaagaattaggcaaaaactagctcaagagaacttcttcctctacttccataaataactcacctagccttttctggtgccagctgttcagatggaggggaagcagaattccattgtccttaccaaatgcatgctttttagcaaccatcccccccttgtgatgaattgtcagtgcattacttctcacatctccgcctaaatcaggtctagttctggttttggaggactttaccttgaaggactgtcccctgggaagctgggcataagccatgtcatgctggcatgtttccagcacaagcagccatgtgatgagttctccaaagcacaagctcttgtatgatccagttcttgatcgcctctgccatgcccagaaggcagggacactggcatctctctacagccacagtgccaccagattgttctcaccatggggaaactccaggacttgagtttttagctgggctttgctccaactgcctctttgtaaagaggtaaaaagaatgcttccctccctaggggacaaggaaactaggctaatgctggtcaaaattttgcacttctttgtagatttccttgcaggaaagcatgtcactgtaagtatataaagtacctggaatactgtaaacattcctatgagcacatatttactatggcatcttttctgagacagtccatatggaatctttaaaccaacagacagtaattgctattaatcccagaaacagtatttagagagtagaaggctctccaaagaaggaacacctcttggcacaatgatgtaaggagttaaccacatggtctacaacaatcccagagaagctcgaaaacatatgtagtgataataatgctcccagcacctaccatagacctcatctcaatgtgtaatgctgggtaaaataattgtctaatgctgcaatgatataaaaaatagttttggtagcaaaataaatgctggaaaaatatgtttaagctttcttttttaagacttacgggcagcactgttttgtatgttttacatattatattgccttatccctagccaaaaacaaaacaaaacagtaagccttctcatactctttgaacatatttgcctgcatctgaaatatcacaataacactcaaataatattattgccatctaaagatgtattcaggcactacaccaccagcaattataaaacatcccttttttgttagtttaagaagtttgcatgcaggtgttaagattatgggaaatcggtggtgaaatatacaatcagggcctacatttttttaaaaaaatatataaattcttgtaaactatgatttacctgtgacagcagagatcttttctctgtctctcagaatagtattgtcatttcttttttggcaagaagaagaggcccctcctcttctctctaagtgttaggctaatacttaggtttgcagtgtatgtttttataactttcagatggtgtgaccatcggaaacagggcaggcaaaaccatggagttaaaaggagaggagtcactaatttaaaggtgttggaggcattctttgaattggagcagtcctaccatgggccccaggggcatgatgtccttgcctagcctgcctcttggtgggaagaagcttctacatctgctcttggctgcagaaaagtaactttcctcattggagggacctgaggatacttaaacatccctaaaggcagcagccccagagtcctgcagccagatctcagaaggcggagggggtggctgtggggactgctgggacatgtggtccacctcttccctttacctgtacaactcctactattccagatgtccattcaaatcagtagttctcaatttgggttgcacaacagaaccatgtggggaggcttataaaatagtgatgcctggatcctaccccagatattcttatttaattatccttgtgggctagcgtgggcatgagaatttttttaaagctctgagataattctcacgcacagccaaatttgagaaccacaggtttggatgatgcttctttggagaagccctccctgacctccaaacacttggctctttagcattcattctccccttatatggactgtcagtgcattaaacttattacacctccatgtaaatcaggactgttcccaagggagttgaccctggtgtgtcagggtcattccatgctggcatgtttccagaacatgaacagccatgtcgtgggtctacaaaacagcaccagcaattatgtgacctgctttcgatcataagactgtgttaagaccttctcctcagtgttcctaacaacatcgcatctctgtcatgtggagcctagtggcactgtgttttatttgtctgctgtctctcccaacgtgactatgaattccctgaaaacagaggtgatgtcattttcattctttactgtgtccccagagcctagcacagggcctgccaggcacattgtaagccctcaatagcaattgttgttttaaaaaaaaaaaaaaaagagttttggtggggcttcagtgaaacaaatcctaatagggactcttatataacttgctgataagaaccttttagttttatggactgaaaccctttccctcctttgtttaaaattttaatgaaattcactattttatttatgtctcaaaaaattacccagctttcaatattttctgaagttgtgtgccatctgctcttctttccttctcagaaaaccttttgatgtatgtgcgtgcatgtgcataggagtgtgtgtgcatgagcatgtacatagtagtatattttaaaaattactgtgagaactgtaattagctacagtggaatcaagttcactgggcatcaaaatatcttgatctggatttgcttaagtgaggcatatgagttagtcacgaaaatgtttgattcttgttacacatcaacagggctataagatggtctgctaaaggggacagattttttaaggaatggagagctatcgataaggtactttttcctgagtacctttattgttagttgaatagttccatttatttatgggctgctgagtgtagcaaggacactgttgtcactcccctgtttctgaaagtatttgtagtttgtcttccctgatatgacacattctgcataaaaccagtgagttcaacttgacatcactgactacccaagtccaggcagcacacacaaactattcctaaacgtttgattatagctggaaaccacagccctagatgtttttatcttgccaaatttatcatttcctaaaatcgtcctttaaaaccattgtcttttgcagccttcaaaccccatcattctctgagaagtgaccattcaagtgatgtcaacagcttggccacactcctccccctctgccccactgtctacctctgccccactgtctagctgcttcactggcctatttttgggttcacaggtcataatagagcttgtttttggttttggttgtttgtttgtttgtttgttctttgagacagagtttcactcttgtcacccaggctggagtgcaatggcatgatcttggctcactggaacctccacctcccgggttcaagcaattttcctgcctcagcctcctgaatagctgggattacaggcgcacaccaccatgcccagctaatttttgtatttttagtaaaggcagggttttgccatgttggccaggctggtctcaaactcctgacctcaggtgatccaccagcctcagcctcccagagtgctggaattacaggcgtgagccactggacctggcccataatagagctttataaataagaagactcaccctatcctcactgccaagaccatgcccttaggattaattggggggaaaaacatgcaaacgtggaatatctttacatccacaaagacctgccatttgttagacattggcttttgcaggagtgaattagatttttggctccaggtttctgtcaggagtcttagttaatatctaggtctgtgtctgcatgggtctttagataaagtagtcactcagttactcttatcataataccatgtttcgacttttggcttcgtgcttatttccatctgttatttccttatttgctatttattcctttcttgtctcatattccccatgagaacagagacctcactgtcttgctcaccatcaaatacccatggaagacacatatttaatatttgttgataaaagtatcccagatgtttatttattttcattttcaaacagaacttttcttcttaaaagtagtaatgtctaaaagtctcagattcatccagtggcttactaaataaaaggaatcatacacaatatgtaaaaattaaagagttcaaatcagagttcaaagagtttgaataaggtactttttcttgattctaatctatttcactgtcagtaactctgaacttcagtttgcaggatgctgtagctattgattgaaaagcagtttggatctctctacatgatgctaaataattgtattaattgttttacagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaac

SEQ ID NO: 36520 - DNA, 27721 bp, Homo sapiens
cagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcaggtaagcctaaaaatttcccttgcgcccccggctatggctacaatttccacttttgtcttcttcttagccggctcgggtcctagtcacgagccgcggtctcgcgtagtcccgcgtgagcgcctaccacctcactgtgccaggccggtcattcacgcgaggccctggctctggcgcggcctagtaggcctcgcgcaaggcctattcccccctccccccgccttttcccggtggcggctgcgcaggagtcagggagggcgcgcgcgcggtagggggggcggcggtggatttgttggttgtggggggttgggggaggcgatggccggcttgctggccgggcgggtgagcgcggctccccgcgggggtcaggcgctggcgcagccacacggggaggcgctattagtccggcccctccccctgtatcgcagcgcccccccccgaccgaaccgtttattttttcccccctctttctagtcgagggaagggggggctttttttcttaagtggaaaatgcttggataaccgaggggagagggggctgcggagttaaagaaagggtagacgggctcccagttgccgagttaatcaggacgtttctcggggtaacgaatttttaaattacaaaatgcctgccgatgtaatcccagaccgagctatttatggaaggggtattggacagcagtgttagcagctggattgctggaatggggtacctttatcttgacctagtcaggagggaaattcgacaaatttcttggattacttggtttggagttagaaatgcatctttgtactttacctcaagaaatggcttcaaataggtttcctgttttgttttttttttttttgccttttcgaagttgcgttattgtgatatttgtaaagggcttcctattacatctgcaagagggtaaggaattaaactaccaggtctttaccacatcttattaaaaaaagaaagtcattcttacagacctaacgcttcttcccccaccaagcactatttttccatgagtgaaaagtgttgaattctgggattttgccagcaattaattgtattctgaaaatggggaaatgatgtgctttggggatgcacttatataatcacttacattcttggagtagccagaggacagtttgccatatacagaatggtgtgacagacacttaagcacctaagatatttagggtatgggctttgtgttagaggaaagttaacacagtggctggttttgtgaaggaggaaatctagctgtgggaggagagagatgacatgttgagttttaaaaggatggatacttaaaatgtcattggggacattctacaacttgggagaggtcctttctaaagctgttacgattaggtgctaaaggaggtattgaaggcaaaggcatatccaaaaaaacaaattttctttctacacataactagttactctaaagcagaaatgttaggaacaatgttaggaattgtttcataggtgggaaaagggccatcttgtataggaaaggtgcatttgctgctgttcttaaaaacaaaaaattttagcaatgccagttttattttgattgttttctttggaaggaaatttaagatttaatagacttgaaataaaaactggatggtaaacacaaaagcaaggaaaacatctcaaatctgagtaacaagttgggttggaaggaggaataggagaaaaagactcaagtgtacttaatgtatcgagtcattttctaaaggggaatatggaaccccagcctgcgtggaaggcatctcagataatgccttttcagtgagggtgttgatctaaatcttttagaaatcatttggtgttagccatcaacggttgaaatttgtaatgtgggatacatctcaatttccttatctacaaattgctactacaaagaaaatttacatgtgttctctctagttttcaacttaaactgctccccagcagggaaacaaaaggtcatttgccctcgctgtagttggagatttgcactcatgatttccaggtgtttctgaattctttgaagctttttctgctgaaggacaagtggtgcacgttcagcagtttccttagaaccattgccaattgaaagaaccttgttcatcctgagagtcagcggaaaccctgtcattaatgagaggaactggaaagttgccttctatactgtgtaacagaacctgagctgtatattttgtcatgcagttgtgcttggtgtgtatataagtctgacatactgtcatttaaggaaaagtgtaaagtagaaaatattgataaggtgaaaataacttgggaaataataaccttgttgttttcctcctctgattttggtcatgtttgcattttagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggtatgctctagcttgggaaatggggtcatagtaactgctaggggaggggccaggaagagcagacatgcatcttggagctcatcagattagcactgtggggcatctggctttagcacatttccctaatggagtagaagtgagtgtagtgggaaaatggacagacttgactaggaagctccactgagcaggaaaggcataattagaggctggagccaaaaactctccatacctggatggtaaggtttttctcatggtgattgcttatagcaagtccactccccccaataaatcttcaaatctttccaatcttttggggtaataattagcatagatagcagtctgttggctagacagttaaaattccttttcataatgaatacttcattagaacatgtagaaaaaggaaaaataaaatatatttttaaaaaggaatacttctgagtttcctcttactgacgttagttttctccattgcaggaagttggcagtatcatcggaaaggtaagacaatttcacttcaacttcaattaccatttagtaattctggattgaagtagcagttggagctcatgcttgacttttcctttacagaaaggagaatcagttaagaagatgcgcgaggaggtaagttatgaaagactgagattgttaactttgggaagtaaaaaacctttaaaacaagtgaaaattctttttcagaaattaggaaggtctcaataagggaaatatgtattttttttcggcttggttatttgtagtgataatctggggagtgtattttttttttcccctttttgggaagtgtggttttgacaagtcagaattctttcaagacttaaggcagctgctgtaggctatctttgaggatagtcatggagcagtagtgtttggaatgatgctgactttgctttgcatcaggatcatgtacattggcagtcttataagggactgtagatcctgtacatactcagatcttctttgttttaacttcttttggatcttgtttcctatctagagtggtgcacgtatcaacatctcagaagggaattgtcctgagagaattatcactttggctggacccactaatgccatcttcaaagcctttgctatgatcattgacaaactggaagaggtttgttgtctcccactccctcattcttcatttttaagtgcttccagagagcttgttgattttctaagagctttttaaattcaaggacacactggaccttgagactcgctgtaaatgggtccttagcttcctgtagcctcccacaaaattcgagcatttgtagtttaaaaaagagtcacttgaggctgggcgtggtggctcatggctgtagtcccagcacttttgggaggctgaggcgggcagataaacgaggtcaggagttcgagaccaacatagtgaaacctcgtctctactaaaaatacaagaattagctgggcatggtggtgtgcgcctgtaatcccagctactcaggaggctgagataggagaaacgcttgaacccgggaggcggaggttgtggtgagccgagatcacaccactgcactccagcctgggcaacagagtgagactctgtctcaaaaaaaaaaaaaagtcacttgaatcatcaaaacagtttgagttttgccatggacttaatataaataatttgcgtgaaaagcatctgttgaaagtatgccattgctttggtaaaaggcttgagtatataccaaactaatatggtttacctgacgttataaacacaaataatcttccaatcctgatgattttaggttaaaaagtcaatctgctaacattgtgtcaaaattacatttgttggggagagacctaggttatcagaaggaaaatacaccggaggttttatcaagagtaagtttttcccccaccaaccttcagaggctgaactgttgtcctgggtcttgtattcagtccctccctctctcccttctgcattaatgcatcagttgggcaattgatatcacaggcagaggagtgctgcttccttggtggttggtacttaatggtgcatgaaatcttatctttgccaagattagaaatgttaccttttgacccccgggattctggaagtccagaactcatggcttagaaaacacgttttattcttttaactagaatgaacttgaactagttcttttttatacatcatagtatttaacttttttttttcttttgaggcagggttgtgctctgtcacccaggctagagtgcagtgatatacctgtagctctctgcatcctcccaggctcaagtgatccttctgccttagcttcctgagtagctggggctacaggtgcatgccaccctgcctggataattttttaaaaacgttttcttgtagagatgggagcttgttatgtttcccaggctggtctcaaactcctgacctcaagtggtcctcctgtttcgcctcccaaagtgttgggattacaggcgtgagccaccatgcccagcctggaatttatttttttatttttttattttttgagacagggtcttgctctgttaccgaggctgaagtacagttgtgttaccatggctcactgcagcctcatcttcccacctaagcctacccagtaggtgggaccacaggcttgaaccaccatgtctggctagttttcatgggttttgtagagactgagtcttcctgtgttgcctaggctcgtcttgaactcttgggctcaagcaatcctcctgtctcagcctcccaaagtgctgggattacaggcagaagccaccatgcgtggcctttattttattaaattttatttttttgaaagaaagctagagtacaaactgtttattccttaaccaaggaataaacatgtccttgtctttaggggtcttaagtgcttaagcagtttccaggtctctagttatcagcctagagattaggctaataagtgatatttaaaccgcttaatcttcagaaggctaaatttaactagattaaaaccatgattttggatgcagcacgtgtttatgggaaagactataggctttgaatcaatacagtcaaatctataggtttgttttttttgtttgttttgagacggagtttcctccttgtcgcccaggctggagtgcagtggtgggttcccggctcaccgtaacctctgactcccgggttcaagcgattctcctgcctcggcctccccagtagctgggattataggcgcctaccaccatgcctggctaatttttgtatttttagtagagacggggcttcaccatgttggccaggctggtctcggactcctgacctcagtgatccacctgctttggcctcccaaagtgctgggaatacaggcctgagccaccgtgccccgcctgtttttagttttctaacagggtagaattgatgtaaatagggttgcattgttttatatctttcgtttttgtttttgtttttgttttgttttgttttgagatggagtctcattctgttccctaggctggagtgcagtggtgcaatctcagctcacagcaacctcttcctcccggattcaagcgattctcctgcctcagtctcccgagagtagcctggactacaggcgcatgccaccacacccagctagtttttgtgtttttgtagagatggggtttcaccatgttggccaggctggtcttgaactgctgacctcaggtgatccacctgcctcggcctcccaaagtactgggattacaggcatgagccgccgtgcccggtctgttttatattttttcttaatattcgatttgacttaattttttttttttttttgagatagtctcactctgttgcctaggctggagtgcagtggcacgatcttggctcactgcaactttgcctcctgggttcaagcgattctcccgcatcagcatcctgagtagctgggattacaggtgccagccaccatgcttagctaatttttgtatttttagtggagacggggtctcactatgttggccaggctggtcttgaactccctgacctgaaatgattcacctgcttcagcttcccaaagtgctgggattacaagcttgagctaccgtgcctggcagtatttgatttaattttgacatcatcttttttccccattgcctggccaagtgtaactgcaaaacagattattacttttatccttagcaagtacattccttcagggtgaaggaaaatatatttatggctaattttgaggaatttttcatgagcttttatctttacatcaaaaatagtttgagaggggcatggtatttgaaccttttgtctatggtggattatgacctcgcatgtcctaataagatcacttaccctaataagggtaagtggttctttaatggcagttactagtttccagggatctgcttattgtggtgttctttctttctgtaggacataagcagctctatgaccaatagcacagctgccagtagacccccggtcaccctgaggctggtggtccctgctagtcagtgtggctctctcattggaaaaggtggatgcaagatcaaggaaatacgagaggttagtgacttttgtcgtccttttagaaatgttaactatttgttccaaattggctctttgtatggctaggaaaagttagcaatgagatgaagatttttattgaagtaacagttctagaggattacaatgtgattgtactgaaaataaaactcatgcaatagaattattttgcataattcataaattttaataaatcagaacatgagaatgttaatcagaattttcaactattacatatgacaagtttctatttttttttggcaacttttccatgaggctacatagttctttttcatgtctcaagggatgagtttgctatagtagcaacggtttttctattttttaatttttaactttttttcttttttttgacacggtctcactctgtctccccaggctggagtgcagtggcgcagtcatggctcactgcagcaaaacatcgaccttcccagcctcaggcgatcctctcatctcagcctcccaaggagccgggactgcaggctcccaccaccacacccaaatttttgtatttttttgtaaaaatggtgttttgccatgtggcccaggctggtttcgaactcctgagctcaagcaatccacccacctcaggctcccagtgttattactacaggcttgagccagcacacttgcttgcctgcagcgtcatttttcttgaccagacttataaacaacaaggagaaaaataggaagatgtattgggaaatagatgtaattctacatctttttttttttttttgagacagggtctcactcaggctgaagtgcagggcataatcgtgatcatggcttactgcaacctcgacttctgggctcatgtaaccctcctacctcaagcctcctgagtacctggtaccataggcgcgctccacaatgcccggctaatttttcttctttctgttgttgtagagacgagtctcactgttttgctcaggctggtctccaactcctgagcttccgatgattcgactgccttggtctcccaaagtgctcggattacagatgtgagccactgtgcctggcccctacttcctgtttaactatggaagttacgttgaattatggaagattttaattgtatctagatgttactgaatttggtgttggaatgaaactcgaatggctgcttgagtttttgggagcgtatcgtacatggcacgacagagatcttaattttgttaattgctatattcgaagcacttctcatggtacctggcacatagaatggccttgatgtaaatattttttcagtaacataatgaaaggtgggtgatacttgtggggcttttgcttcgcccagagaactatcattagttgaaaggcaactatttagaaggaccttttgcttgagagtaggttaaatttaggctgttattcacgcttattcttgtctttcagtggctaatttatttttaactctaattcactaaacagtcctatctggaataagggaagagtgggacaaagaacaaaaagggaagattggaaatggataaatatctactagagttttaggctctgaaattgctgctggaggaattggaagagcatgaactgtttttctctgattttgaatttctttttactccaaagagtacaggggctcaggtccaggtggcaggggatatgctacccaactcaactgagcgggccatcactattgctggcattccacaatccatcattgagtgtgtcaaacagatctgcgtggtcatgttggaggtaagccctcaggctcatgctgaaaatggggggagggccattctggggacagagggactgatctatatttagtaagactagaattaagtgaggctgttaaggcttccagtgggggtggggctaaaaggttccctgagttcatattttccttcccctagctttgacttttcttatggtctgtgagcaaaaatagaaactgctaagcagcagtgatcttttggttcacagcagttgtagcagagtcggggagaagatgcactgcatggactaaggaggccagagatttatttgagttcctgagtagctgagttaaattactttttgaattactgtattttggttacatggaaatttgacatgttctttaacaacttgtcactttgtaggagggtattcaaagtgttacatagagtagaaaaatgtatgtatgatgatgtttccgaatgacttacaaggtcctgattatacactattattctattaaaagaatagcaaaattcaggaaaattaagccttttcagatttgtgatatggagttggtttcattggtgagaaatgaaacgaattttttcgtgtgtgtgtgtgtgtgacgggttcactttgtcacccagactggagtgcagtggtgcagtatcggctcactgcaacctctgcctatcaggcttaagcgatcctctcacctgtctccccagtagcttggtctacaggcatgcgccaccacacctggctaattttttttattttttgtagagacgggattttgccatgttgcccaggctggtcttgaactcctgagctcaagccatccacccgcctcagccttccaaagtactggtattaccagcatgagccgatgcacccaacctggaaactggaattttcaagtagagattagaaaaaccttgattgagcctttgaactatttatagatagtgtctgtattattctagacataacacttgagtactttatttgcagttttgaccttatttcctattcaggccaaaaaaatgtgagatactaaaaattatcaacaaaaatatacgtttaacagtttttcatgtccattaaatttatctaaaattttggaaatagtgccgaagattattacatggacatctcccttgatgagaatcagtttgaattgtgtagtccttggacttactgcattaaaggcaaataactttcagtagataaattgagattagatctagccagagacaatttggtaggtaaggggatggaaatagtttttaatttaactgacctgtgtgagctaaagccacacagctgaagcagctttgaaaccttatctctttttgtttttttcccctctgactctctcccagtcccccccgaagggcgtgaccatcccgtaccggcccaagccgtccagctctccggtcatctttgcaggtggtcaggtaagaaaattctcatttgtgggctagaatgaacagagattatatttgaaatgtcaactttgccagcatcacaccaagccactctgcatgcttgctgaaacctatactctggccatagtttgaccggcttttagttttatttttgtactggagaaagctgaatgccttaatttttagcaggcaatggaagttttgtaggcactcggaagaggtaacttacttgtgggttgggttagaatataagagttgaattgacttactgtctctacttctctccctgtccccaccccatccatgttttatgtgtgtggggtgatatttagaggtctaaataaaaggtagcaaagagttggacctctgaaggagattctggatggtggtctcaaaatttgggggtcctgaatttgagtgtcctacaaacttccccttccctccacctcacctcccctactcctaccccttcactcccaaactccagtgtgttgtcccctaggctcttaacctcataaacactggtttgaacccacatggcataactgaaatcagctggggtaagagttcagtgtgcaagaatagaaggggggtgagcatgttgggctgtggtgccgtgacctttggtgttagagtaagaacaccaaagcaccaccgtggcctctctgctccttcctcatcaacctaaactcttgatctttggcacgtggactattctgaagttagattattatgacagaagcattgaaggaccatggtagtcctatgctctgattgtatttgaggagtaggtagatcaggttttaaaatacagttggccctttgtgggttccaccttcaacctacctcagatcaaaagtattcagggaaaaaaatgggtggttgtatctgtactgaacatgtacaggctttgttttgtcattaaacaatagagtataacaagtatttacatagtatttacattgtattaggtattataagtaacctagagatgattaaaatatgtgggaggatatgcttaggttatatgcaagtactataccattttatgtaaaagacttgaatatccatggatatttgtttctatggggggaatcctaggactaatctcccaccaataacgtagggacacctagggacaactgcattgggattcaggttgaaatagtgactgattttggtagctgcctaagcaagtgcgttgctcaaaacaccttttcccacttggggctggtctgttacaagcatatttagttaactagttccatcttacctgcgtttgatctgggagccatttagagggcaagcataaacttgggagtccatctctttcacattgtgttgaattggcataaaaatgaacaagtttttagaggtttagtttgtcgtgtagttatgagaggtttcacaggaaggtcggttatgtcacagtgttaaccttgagtcagtttagtaccttgcttttagaaaagtacaaactggtttgttcaaagggctctcagtctagttagtcagagttgggcaggataagcaaaggcccagagtcagtgtcgccagaaggatttagccttaggagtttttctttcccaggaactccaggttcctgctcttctggattctcccactccccctttggaatagagtcccatactgggtggcagcaatcctctgtacttaaaattcttccttcacttccttttttttccactccccatcacacctcccccttcatacctctttgcttccctacccaccctccctccctccctcccctttatttagttgatgaccaccgtctaaaaatttgcagcttcttctatgagtggccctgtcatggattgttcccacaggcctttttaaatatacaatgtccacagatggacctgtgtcttttgttcctttgtggcaaagtgggctctgtaggggttcaacttaatcccacactgaccaggagctggcatcagctctgttgccccaccccttcattcttattgaaaatagcccaattgtgcagtgtgaaatctgccactaggtaacttttttttttaattcactgattacagctcgtttcaaattgtgtctgagctcctttttaaaggaaaaaggaaaaaaataaacaactttttttgtgtgaatttcatgctggtgacaaggtgccggattgacagccctggagactgaaatcctctatttatccacaggacaggtacagcacaggcagcgacagtgcgagctttccccacaccaccccgtccatgtgcctcaaccctgacctggagggaccacctctagaggtgagaggggatgttcagtctccaaggctcactcaatccttccgcctcagccgagactgccaacacacggggggccagtggcgctggtgatttttggtgctgtggacaccacctgtccacggggacctggactgacccccccaacctcatttcacccaggccgcgtagcccaccagatggtaacaccaactttttttttttttttaattttttttttgttcaacccctcttcccctctcccactcctcccaccccattttcaccttccttccacccccacctgggtgtacttttgggggtactggccactgtgatgtgagaaacttcacatcctgttaaccagccactccttccatcccctccctccctgttcccttttcctttcctccttttccctaccccattgccctgaagacccagctccctttttgggaggttatgttgtgggggggaggagggcatagtgggagctgcaaatgcctatggaggggaggtgggagaagacaggaattagaacccagtggtttttgtttacctgtgatcagctccctactgttagggactcagctagcatccagtgttcttaaggtctttaggcagatagagaaataagttggagaaagggaagtgttttaaaacataccatgtaggtttgtgcagttagagatcttccacatcaccacaattggtagaagggttggggtggtgagggaagagatcattattcctcctaggctatcttgtatacagggaggaagagtggggcttggtcagtcgaggcattgctaatctcacttcccacattttcattaagaaacagttatgtatattttgcctttgattgcagggaacttggctacctttataggattccccggaacaaagtcatatttagggttcaaagaaggccaatttgggtctgaccatatttgtgagattccatctactgcctcaatctctggcctcccccattctctagttcaactctggcttcctggctagttgaaatgtctttttccccccactgggtggctgtccgtgattggtttttaataggaactgttttcctccttttgtaggcctataccattcaaggacagtatgccattccacagccagatgtaagttttgttttcacttcttgttttgaaaagctccctctcccatccaaaattgtctcactcctctctcccaagtagccagaagtgagttgggtcttcagcatttgcagtattaagttgttttcttcacaaggtcaatcccatattttagccctttaatcagggtaatgccttgtttgccttttaacatttaacccctgaaatttaattcagcacattagcttctcctttccccctgtgtttcagattaccctgtttctaaaagggaaatgttccatggtatactgtgatttgttatctcagggcatagtttaaattgacattgggactgtgcttccttgcatgcagttctcttttccatgagggtaatgggaggttgggtttgcccttgggaactcctcaatctgagatgacaatttgaaaagtatttggagggatggggaaggggcttatgttacacagagagggataggaacctgaacatttcagaattcaactcaaacctttcttgctgctaaaacctcctatttaaaagtgccggtatttagacttcaagggcatttttttctgcacttttcttttatccttactaaccttttcaggtgctgagcattattagacttgggaagttgagtttcggtcttggttagtggtaggccccaggagagagggaagtagacgtgaagaaggattattttatgacagtcaggacagtttatatagatgaataaaaatagctgtagtagtcagtggtggcggtgatgggactaaacccagtatggtttcttcacctctctcctccttgcagtctccctgcccccctcatctccttccctctccccaatactgatgaaaccctgcatggtgtgttttccctagcaccactgcacagtttgtttacctagcctgtctgtgcttgtccctgcggcaactgttgcaatggctgcaaactaccttcattaagtagcctccaagggggatggtcgttgggcaagtgctgttgcttttctattcccacacccaaaaggcattcattctcttccaggcacccattctatttctaacccttacccttcatattctgccaatccccaggattgtgatgcaagccccatccctaccctctgttgtagtttgagtagtagagtcaattttgggaatcaggacctgcattttcaaattcgaatgtgcttgagccctggctctgttaaatcttctaatgccaacctcctgtttcctccttgcagttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgaggtttggggatgcttgtcaggcaaagggtaggctgatatttctttgagcccatcctgactgctgcccccttgatctgatcagcaccccctttctctccaccagcaattcacaggcttgggtagagaccatccatttgtgccaaattgtgtagtgttttttttgtttttgtttttgtttttattttgtttcgtttttggggcttttctgtataaggaataacttgtccgatagggttaggatgagaccaccaaactcattttcacttgtatcttaacaggcattgaatccagctctccagaggtgaaaggctattggggtaatgattaaaaaaaaaaaaatctgtagtattctactgttatattaataaactggtgggagtcttgtttcactgcccatgaaccataccagcaacatgcacatggcagagaggagctgagagagcaaaggggtgggcctggagcccccgagggtcccttgatggatctggccaacccccttctaaaaatgatgagacagcagccatagctgagatcaggactaagcttgagtgttagccagctggcctggttcagtccaggtgttgttaaagatgggtacgggtatttgctgatgggatttttttttctttctttttctttggaaaacaaaatgaaagccagaacaaaattattgaacaaaagacagggactaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatgtaagtgtagttaggttgcatgggatgaaaataagaaaatagactgtaaagaaatagatgtcgtttcagcagtgtcctgctaccctttttttttttttttttttaaacagcccaggctgtagtgcagtggtgcgatcttggctcaccgcagcctccgcctcccgggttcaaccaattctcctgcctcaacctcctgagtagctgggattacaggcatgtgccaccatgcctggctaattttgtatttttagtagagatggagtttctccatgttggtcaggctggtctcaaactcccgagctcaggtgatccactcaccttggcctcccaaagtgctgggattacaggtctgagtcaccgcacttggcctacatgtcctgctacttttaagccctagggaaagaaactgggaattttattattttatctttatttttgtttttgtttttcataccccaggaatggaaaatgggaatttttagacacaaaaataagttgattataatatacagaattgtgatgacaaatatgataagagaaaatagactattattgtgtgaggtatgacgagacagcagtaactttttgctgaaaatagaaattcctggctgggcacggtggctcactcctgtaatcccagcactttgggaggccgaggcgggtggatcacctgagcttggaagttcgagaccagcctgactaccatggaggaacccatctctactaaaaatacaaaaaaagcaaaaagcctggcatggtgttgcatctctgtaatcccagctatttgggaggctaaggtaggagaattgcttgaaacccgggaggcggaggttgtggtgagccgagatcgcgccatcgcactccagcctgggcaacaagagcgaaactccatttcaaaaaaggaaagaaattcctgtacatttgctgctttttttttttttttttttgagacggcatcttgctctgtttcccaggcttggctcactgtgacctccgtctcctgggttcaagcaattttcctgccccagcctcccgagtagatgggactacaggcatgtgccaccatgtccggctgatttttgtattttttttaattagagatggggtttctccatgttggtcaggctggtcttgaactcctgaccttacgtgatccccccccttcagcctcccaaagcgttgggattacaggtgtgagccactgcgtccagcctgcttttgtttttttgtagaagctaaagccttatctttagaagatgttgtggttttcagccaggtgcagtggctcatgcatataatcccagcacttgtgggaggctgaggcaagtgggtcacgaggtcaggagaccagcctgaccatagtggtgaaaccctgtctctactaaaaatacaaaaattagccaggtgtgctggcccgcacctgtaatcccattactcagaaggctgaggcaggagaatcccctgaacctgggaggcggaggttgcagtgagccaagatcgtgccactgcactccagcctgggcaacagaccaagactccgtctctcaaaaaaaaaaaaaaaaaaaaaaaagtgtagtggcttttttttttgacaaagggtctccctctgttgcccaggctggagcagagaggcatgatcgtggctcactgcagccttgaacttccaggcttaagagatcctcccatctcagcctcctgagtagctgggaccacaggtgcatgccactatccctggctaactttttttgtattttttttgtaaagacaagagtttcgccatgaaactcctgaacgcaagtgattggcctgcctcagcctacaggcatgagccacggtcccccaccatagtgtagtggttcatgaacatcagatctgtgctgtccagggtcatattttttacagtattagtgcaaatgttaaccagtttttttttttttttttccaccttttcccaaggcaaaaacaccttaggaattggccagaattcttgtcggtataggagggtggtaatcatggcaggatgactttaagcatatttgctgccagaaacagaatgtatttctacctttatctatttctagctgtctaaatttatttttgttttggctctgctttgtctttggaagtaatattctgaggacagaaataatgaagagctaatacttggacctaagagtattatgtctcttggacctaaaagacagttctgagttggctcagaactggctgtcactcaccatgggtggtcagactgaaaaatgggtcaagagttgagttttttgatcaaaagtgtatgagtaaagggtgtaggatgaaattgggcatggcggtatacacctgtaatcccaggttacagggagcacagagatacagaggctgagattcgaaaatggcttaaaccaaggagtttgagactagcctgagcaacatagcgagaccctcggtttttttttttttttttaaagggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctggccacagtcgtaggatttggggtgggggggtgggattcttagacctagccatgcaactctaattcggtgtgccttgtttttctttctcccttaagttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggtaagattgctctaccttttgtcttatttatgccaacacagtaatgtgtgtgttggggagagctgcagtgtattaaatatgggattacatgggcgatgggtaaagatggccaaaaggtttttttttttttttgctagctctactttcttagagtgtagcagaaaaagtaaactgcagtaagttttcaaggggttggtgggggggggagcacagattgcccgcatttaacttgatggtttggtaagagggaagagtggtccttgtcttcagtaagagtcctctggctagagcactcacaaaatcaaatgtgggtctctcttgttctacatagcatatagactactatttctttcactgatttgatttggagtccaaagcacccttaattgtaataaggacattggagtaataggacagcaaggcagtttctgggaggcagcaattaccatttattctggaaacacccatttttctcacactgcatgtgtgttttattcagagcttgtgggaatgtgggaagcacaggtattggaatgtttcggaagtgtgaagtgtgttttctatctcactcctcccccaatctcatcccttaatgacttcctgagggttttatttcccttatccatagctaggtagtgttactactctcaattttaggacactgttcacagtcaaatgggatcctacagtcatttatattacttgctttctcaactcatgggctgaagtcacacccttaattgcttactaatatttcaaagcattgttagccttgaggcccttaggtctcttttaatagggaatgttgtctagttatcatttacctttcttataagtgtttaatctctttgtcataaaagttttacatgagttcctgaatctagtacaggggaaaggaattcctaagtatgtggtctgtattgtgcttgtactgaccatgtatatatgctatggttatttagtgctagctaagaacataccatttccccagtagcagtctgacttttgccttaagacttcatatcttgaggtgctactactctttgtgtagaaaagctttccctttcctagatttgttttcttgtccacccaccaagcacactaggtccttaatgttgagaatgaaatggtagtagtaaacttttgcaccaaggttgtttgcaaagaggtctttttcttttttagagatagggtttcatgttggtcaggctcgtctccaactcctgacctcaagtgatatgcctcccaaagtgctgggattacaagaattgtttttctttcttttttttttttttgagacggagtcttgctctgtcaccaggctggagtgcagtggctccatctcggctcactgcaacctctgcctcctgggctcaagtgattctcctgcctcagcctcccaagtagctgggacttacaggcacgtgccaccacgtccagctaatttttgtatttttagtatagacggggtttcaccatgttggcaaggatggcctcgatcttttgaccttgtcatccacctgcctcggcctcccaaagtgctgggattacaggcgtgagccactatgcccagcttgtttttcttatttgtaattaggattttggagggcaagaagttttcagttttcagtggcaagaatcaggtttttgaaagctggaatttgttttgttctttcgataggcttgcccttcatgtaatttaaattgtgactgtttaaatgtgacctgcttgcctagctcctgcaataggtcagtggctacattgtaaggaagcagaattctcttggtagagtggctcttttcaggatcattgttactgaatagcaattcggtatcttagccatggattagggtcaaaacttttcaaagcttcatctaacaccaaagcaaagattatgcatgcacaaagcttattctttctcaacttggtgcagtttaaatgcagaagtcaaagggtttttttttttttcctttctcattttttttaagtcaagaaggattttactggattctgagcattttctcctgtctcttgatttttcatggtggcagtctgtccttttatatagttagttgacttctgtatccctttcctttatggattgcagctgtccttggacataggtaaataaaatgaggttttaagaggagcctttctgctcttgaagacttagcgttgtgggctcaattgtccaggcacacttcccaaatatatgtagttctggcttagacacatacaggcatttgggagacatgtacccttactgttctgtggagcttattttgggagtggaagcagcagcattttcgcttaagtatgaatttttaggtgatacttgagtttctcttttccacttctgaaaggtccacattagaagtatgatcagtcagaaacaactttttataccacctcccaccagaaaagcttccctagttcttatctacacttctgttctcagcatttttctttgaaaacgctacattctttgaaatttgaaattagtcagtgacctactttggactcttgtctctttccaccctgatactggtttgtttgctgtggagatgtaagcagactttaatacatagctggaaggatttttaaaaattctgctttataaatattcaaagcttcacaagtaattgtgggataattgattttctgttagaataggaaattgacatttgattagaggaaacatttcttccttgttgggtgattgatgagtatctttttctacccgaaatcattccttcaacatctgggttgggtcagtgtgtcagatacatgaagtatgtgccctatgatttcttttctctgtcagctttttcttcaccatagcagtttttaagtagctctgtggaatggaaatatacatatttagagggtgggacataggctaaaagaaagcttgtcacaagttgacactaggtcttcctaattgtcaaccagaggcacttactgatataactgaagcagtttttgtcctgtacttactcccttttgtggtcttcccttccacccaccctttttttttgttccttttttcctctgttacagtttagaaaacgctaaaccctcctcccaggcagcctccgtcacgatccctgatcacctcagcatcaacctctctcaaccctccaccccttcttcttcttcctcctccaccaccaccccctcgctcgccacagcggggacctccgacgcaccctccagcctccccaaccctcttccgaccgccccttgtgtctccagtctgcttggcatgaaacccatccctctcctggctctaaatgttgtgtctgctgctaagggtaccggggcttcagctaccaccaccaccacctctgccgtgccatgtgtaactaacaaactgaaaggcgagaaacagagattctctccctactgattgcataccttgaggcacctcctccagtattattttgttcattttgttttcctttgttaacattggtgagaatgaaactattgtgagcttgttaccgtttcctttttactactttgggggataactgggtgggggtgggggagtggtaacccttgtttaggtttaggccatttcagctgagtgcctgtttcagggtctgacttgaattctttatctagagccacagttttctcttctttcttgtttgttacttttctttgtagctttattctgccttgcaatataacaatgtgttaggctctgtgttaatgaataaaagctgcttcgttaacttttttttttttttttaagaattatttaatggttaagctatcagcaggccttcttggccatatttgtgtttctagctgtaataaagttggcgcagtaagaaccttagtacactgtgtgctgtgaagggtaaagggttgggggcttgtgacttgtggctattcagctaggaagcctgtataactgacatgggctttttgaatcccaagtgaattttatagtcgtttgtcaatatttccacaaagagataacgagtctgtggcagtttagatcctgaaggtcctctgtaattggcaacaagcttcactagtgaggaagtttatctgacttctcagatggccttaccttgccagcagcagctaacaaggtgttcatcccaggattcctctggtgaatggttaccatgaggatctcttccaagtcatacattcaaagaacatacttctttacccagaatgaaggggaggggcaaagtgggataagtctaataaaattaggcagcttctgtctgcattcctctgaattagcattatgcctctttctgtgacattaggtatatctcagccaacccgtgacattatccacaacttgacatgatgccatccactagtcctaaaccaactctgtcaaccaagtttctttacccttttttctattcctggccgtatcctttctgctccccaccagcactatcaggagtaggaagtgacatgcttagatttggaaggaaccttaaggatcaactaatctgtaacacattgatcccctcattttacagattaaaaaatagaggccctaagataatttaaattcataggttatgagtgactagccaggactaacaacttaagctttacttttactcaatcgtactaacctccctgaaatcttgttcattttcttatactaagatgggcacaggcctctcataaaacagtagaaatgttcttagtatggtggtataaggcctctgatagccttccattcaacgagagtacacgttgccacagtgctgaaagtgtaatgctcttcccagggcattagagaactcagtgtagagatagtttccctgatgaccttttcccagcatcaccattggctgacaaaaaaaaaaaagctgttagtattccaatatattatctcattctttgatgttattttggcccctccatcccagattgggcctgtgaagaagtgttacacgtctcaagtatgcataaaggattagatggccaaacctgtccagtaaggagttttatttagttgctcctttatcatgtggtccagctctctcccttggtaagcttgctcctcctgtagttaggacttaatcatgctgataccatctccccccagggatgtggttttatctagttcttgattggaaggcctcttaacctaatggctattccccaaggaaggattccacatgtttaagggtctagctaccatcactacctccaaagggcctcagttttaaatttttttaaaccctagagctcccccatgtggtcttttatcctagagtacctgactcagtatttcatagcatccccttctccctgcgtcacctcccccaccccagcaaatccccattcgggcttgatacacattcagaacatttctttcagagctctggtggggccagagtgctaccaccaatttttatgaacttaaattttcaggtcctagatctaatggtatctagcagttcctttcttagaccttcagttcttactgaaccctttaatccagggctattgtttacctttccttagatcattgtgttttgaaattggcacgaatctaccccccttttaagaactaaatatcccctgccgggcacggtggctcacgcctgtaatcccagcactttgggaggccgaggcgggtggatcacgaggtcaggagatcaagaccatcctggctaacacagtgaaaccccgactctactaaaaacataaaaaaattagctgggcatggtggtgggcgcctgtagtcccagcaactcgggaggctgaggcaggagaatggcgtgaacctgggaggcggagcttgcagtgagccgagaccgcgccactgtactccagcctgggtgacaaagcaagactctgtctcaaaaaaaaaaaaaaaaaaaaaaaaaaaaaccctaaatattcccttaatactgaggtggagaaaccatttctgactaaaagtaaatagtttgtagtcgaaggactttgcagttttttggcccttgcttttctacccagcttttggctttgcattgttgtggaagggatacagatggtgaattaccaatcatgttttcatgaccacatatcacaaatattttatgctaatcagtttaaaatcttatgaaataacttatcttatgaactgaaatgaagtcttatacatttggttctattcaaaatgagggcaaagtcttgctgcctacctacctaccagtgaagcatactgagtacttaaatacttttccctgaaagccctaaattggattccaggacctcaaatgactatctctttgaaacagaaaggcattgtagccaggtatgtttagatggaggatatggcttgacaagatctaggagcttgtagagtgagctacagagttgaaacaaattattttgtctgctacttttaagtcctgaaaactttttaaagaactttttaaggccgggtgtggtggctcatgcctaatcctagcactttgggaggccaagacaagtggatcacctgaggtcagaagtttgagaccagcctggccaacatggtgaaactctgtctctactgaaaatacaaaaattagctgggcatggtgacagctgcctggaattgcagctactcaggaggctgaggcaggagaatcgctagaacacgggaggcaggggttgcagtgagttgagattgcgccattgcactccagcctgggtgaaactcagtctcaaaaaaataaataaataaataaggccaggcgcggtggctcatgcctgtaatcccagcacattgggaggcagaggcaggcagatcacctgaggtcaggagtttaagacctgcctgggaaacctgttgaagccccgtctctactaataatagaaaaagtagctgggagtggtggtggctgccagtaatcccagctatcaggtggaggctgaggcaagagaattgcttgagccagggaggcacaagttgcagtgaggcaagatcacatcactgtactctagcctgggtgacagagctagactctgtctcaataaataagtaaatctgagtataattcttgacccatagttactctttttacatctctttttaacatttttttttttacctttaaaacggtattacctcataataccctacacattgatagaactccagggctttaaagtaaaggccttgagttgtctcagcattaaacccttgagactactctcagatgactctttctttcctaaactggtattctgtcagcagtttgggaggagccaaagtgagctcagcaataaagaaacattgcttctgtgtattgtgagcactctttagaggggcctgtttccagaaagtacactccttggttagcccaccatggaggtggaactaaaagagaacatagtttgagggacattggataacaagggctgtttcccttggttctgaggtaatagacctccacatgcttgaattgcaaggattaaaggatcatggtactggtaaatttaagaaaccttaaaatgtctcccttggtactccagcactggttatttactcttcacatttcatgaaccaggtagagatgaggtgcagctgagcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtg

SEQ ID NO: 36521 - DNA, 20525 bp, Homo sapiens
agtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcaggtgcgggtggctggacctaggaggggactgctgggcactaggcggcagcaaggacggaactccggggtctcttaatagggagagatccggggggacccacgcctgcatcttgcggaaagcggggtggaggtttagggctggactcttgggtcctttaaaggtgagtggtctgggggcctctgggcttggggccagacccctgggtcctctatgaaagaacgtgctggggaccctgattttgggatgttaggaagttggaactcttttgttctgataggggaaggtagtggggctccggactcccgactcccggggaaagagtgggctggggtttctgcttctggatcttaggaagaggatagggtcagtctggactacttggcctccagtgggtggaagtccggttctgcgccctcacctgggtcccccgttcccagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctggtcagtccggggaccaaactcatggatcccagcggggctgggctgcagcgtcagtggaatgggaagctggggcccagaactcctgagtctgagggagaaggatctgggctgggactcccaggtcctttctgtaccctccggacctgtccctcctctctctcccagtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgtgagttgggtgctgggtccccaagagggtggtggcctggacttcttaaacttaagggaagaggggactgggggcctgggatcctgagtccttggggaggagggacctcaggacctgggtttctgacccctgagctcatatttctgggaggggggcaccataaacccaggtggggcactggggcaagaggctctgggcaggtggggcactggcggaactcctaagtcaacagcatttaaggagtttccttcctaaagcttaggggcagccctttggcctggcatgcatctccataaaagttgattaggggctggaattctgagggcagggctgagaaggaaagagacccagtcctgtcttgcggaaacctccgtttgaggaaggagcatctgggtgcttagaacccggagcccaggactaggaaaaggacggtgaggaccctggagtgcaacatttaaggaggcactcgctctcagggtcctgtaagtgcagggtccgcacctgtgagtgagcgcctccttaaatcttgcaccaacagcctcaccctagtcctagccctgccgttgcctcacactgggaagtctaaaggttcctgccttcctcactttatttgccacaggcaccagcgggtttccggccagaattgcaaccaggccgaaggagggagggccaggggagttgccctcagagagagggaaacagctggcagggcattcttctgatcaattgctaaagatgtataataaagtttggctgactttggggacagaatgtcaggtgacagaagacagcctccaggttagagagttttgccaaatagggacagttcatttgagtcagagtgtttagaggaaatgagggctgtgtgtgggaagagagttcagctacaatggttacagaagctttatttcaagcctttctctggaagcaggcaaaaatgcattgtacatgtatgtacattgtacataataggtgctaacaaacatgtcttgaaatgaacgaagggtttagctatggtagatttagcttcagtgttttttttttttctttctttctttctttcttttttttttttatttgagactgggtctctgtcacctaggctggagtgcagtcagccttgacctcccaggctcaggtgatcctcccaccttagcctccctggtagctgggaccacaggcatgcaccagcacgcctggctgatttgtgtatgttcttgtagagacagggttttgttatgttgcccaggctggtcttgaactactgggcacaagtgatcctcctaccttggcctcctaaagtgctaggattacagggcttctgaaagtgctgggattacaggcatgagccactgcacccacccttttttgttgttgttgtttgtttgtttgtttttgagaaaaggtcttgctctgtcacccaggctggagtgcaatggtgggatcatagcttactgcagccttgaccttctgggctcaggtgatcctcatgcctcagcctcctaagtagctgggactacaagcacctgccaccatacctggctaattttttaattttttgttgagctgtaatctcactatgttgcccaggcttaatagctttattgatataacccacataccatataatttatctatttcgagtgcacaattcaatgacttttagtatattcagagttgtacatccattactaccattaattggaaaatgtttccattactccaaaaagaccccacaccccttagccatcacccctatccttcccttttcccccctcagccttaggcaacttttttttttttttttttttaatttgagacagggtctcactttgttgcccaagctagagtgcagtggtgcgatcttggtttactgcaacctccacctcccgggttcaagtgattctcttgtttcagcctcccaaatagcagggattacaggcgtgcgccaccaagcccagcaaatttttttgttttatttatttatttatttatttgagatggagttttgctcttgttgcgcaggctggagtgcaatggcgctatctcagcttagcgcaacctcagcctcccgagtagctgggattacaggcatgcgccaccatgcctagctaattttgtatttttagtagagacggggtttctccgtattggtcaggctggtctccaactccctatctcaggtgatccgcgcgccctggcctcccaaagtgttgggattacaggcatgagccactgcgcccaggcacatttttatttatttttttgagacagtcttgctctgtcacccaggctggagtgcaatggcaagctctcagttcactgcagcctctgcctcctgagcgcaagcgattctgctgtctcagcctcccaaatagctgggattccaggcatgtgccaccatgtctggctaatttttgtatttttagtagagatagggtttcaccatgttggccaggctggtctcaaactcctgacctcaggtgatctgcacaccttgacctccccaaagtgctgggattataggcgtgagccaccatggctggcttgtctgagattttggagatgggggtccatttttctctcctttatttttccttctactttaaaaaaatgaattgttagcctgggtgtggtggctcatgcctgtaattccagtacgttgagaggctgaggtgggcggatcacttgaggtcagaagttcgagatcagcctggccaacatggtgaaaccctgtctctactaaaaatacaaaaattaagcggtatggtggtgaggcacctgtaatcccagctactcaggaggctgaggaggcaggaggagaattgcttgaatccgggaggcagaggttgcagtgagccaagatcgcaccactgcactccagcctgggtgacaaagcgagattccatctcaacaaacaaacaaacaaacaaaaccgagttgttaacattcatggaatgaaaggagtccacatattatacatgtgtatgagtacttacccagatcccgatacagaacttgcccatcaccccagaagtcttccttgcctccctttctggccaatgaccgccctcctaaggcaccattcttctgatgcatttaaccacaggccggttttgcctgttctgacattataaacaggacttatacagtgtactcttttgtgtctggccttttttccactctacatgatgttggtttatacttggagttctttccttcttattgctatagagcagcagttggccacctttttctgtgaaggaccagatagtaaatattttcagtttttacaggtagtagggtctctgtgacagctactcagctctcttattgtggcatgaaagcagccacagacactgcataaatgaataggcatggctgtgttctaataagactttatttgtggcctctacatttggattttaggtcaggctcatgcctgtaatcccagcactttgggaagctgaggtgggtagatcacctgaggtcaggagttcgagaccagcctgaccaacatggtgaaaccccatctctactaaaaatacaaaataagctgggcgtggtggggtgtgcctgtattcccagctactcaggaggctgaggcaggggaatcgcttgaacctcccccgggaggtggaggttgcagtgagcccagatggtgccattgcactccagcatgagtgacaagagcaaaactccatttcaaaaaaaataaataaataaaataaaaaataaaatttggatttcatataggtttttttttaaatttgtttgagacaggctcttgttctattgcccaagctggtatgcactggcgtgagcatagctcattgcagcctccaactcctgggctcaagtgatcctcctaccgcagcctcctgagtagctgggactatgggcatgtgccaccatgcccagctaatttttaaacaattttttgtagagactgagtcttgctgtgttgctcagattggtctcaaactccaggcctcaagcaaccctcctgcctcggcctcccaaagtgttgggattacaggtgtgagccccatctagtttttacatgttactttgatagttttcaatgtgaaaaaaagttaaaatgattcttagcttacaggccttacaaaaactgatggcaggccaaatttggtccactggccataatttttgccctacaaaatgggcaggttgtggtggctcctaggctcaagcgatcctccttgcctcagcctcccaaagtacaaagtgaattacaggcatgagccactacaccctattttccttctgattattcagtttttggctaccacgaataatgctgctatgaagattcttctgctaatatcttagggaacattgtcatgaattctaaggactggattttctgggtcactgagtcgacaaatgtttaattttcatagaaactcccagtttcttgaactggttgttcatcttacataaaagatgggacaaatttaagtggtttcattgtagaatgagttttctttctttcttttttttttttttagagacagagtctcactctgtcccccaggttggagtgcagtggcacaatcttggctcactgcaatctctgcctccctctgggagcctcagttccctgcgctaaaacacagggtttatcacagcaccttcctcttgaggctgtttcaaggattagctggctgccttcaggatctccaacccagaggttccccttctaggtgtgaagcccagagacacccttgctcatgtgcacaaaagacagcaggggtgtagggcaggggacaaagtacacagcaggggactgtttaatacatgatgacgctacaaggcagtggatcgccaaaacaggagtaattcttttttttctgagacagagcctcactctgtcacccaggctagagtgcagtggcgcagtctcggctcactgcaacctccgcctttcggtgatccttctgcctcagcctctccagtagctgggattacaggtgcgcaccaccacatctggctaaattttatgtttttattagagatggggtttcgccatactgccaggctggtcgtgagcacctggcctcaagtgatctgcgtgcctcagcctcccaaaatgcagggattacaggagtgagccaccgcacctggcccaagttttctttttttaataaactgattgagaagtgaacatcttagctgccacagggtggccgaatcagaaagttaggtttgctgttaaatatgctggcttagagaagtactgctgaaaacactgatcccccaggtcccttagaatcagagagtctgatttaattgttctgggtggacacaaggaattggcatgttttaaaagctccaccattgattcttatgtggctcaagtgtgggtttcaatacttcctccttttaacattgtgaaacgagtaatttttcttccaacattttattatgaaaaatttcaagcatagagaaaagctgaaaaaaaatttttttttttttttgagacagggtctcactttgtcatccaggctggagtgcagtggtgcaatcatagctcactgcagcctcaacctcctggctcaagcgatcctcctgcctcaggcttccaaatagctggaactacaggtgtgcaccaccactcctggctagtttttgtgttttttgtaaagacagagttttgccacattgcccaggctggcctcgacctcctgggctcaggcaatcctccctccttggcctcccaaagtgctgggattagagtgagccactgcaccaggcttaaaatttttttttacagtgtacatctctaaccatccatcacttcatctttttttcttttgagatggagtctcactctgttgcccaggctggcgtacagtggcacaatcttggtttactgcaacctctgcctcctgggttcaagcgattctcttgcctcagcctcccgagtagcagtagctggatttacaggcgagtgccaccacacccagctaattgatttttaaaagatttttagtagcgatggggtttcaccatgttggccaggctggtctcgaactcctgacctcaagtgatccacctgccttgacctcccaaagtgctaagattacaggtttgagctgctgtgtccgacctattcttttttttttttttttgggtgggggtctcgctatgttgtccaggctggtattgaaccctggctaaggtgatcctcccgcctcagcctcccaagtagctgggcctacagacgtgcaccatcatgccttgctgtaattgttctattttattattagttattattgatttattaatgtgcctaatttataaattaaactctatcataggtgcgtatgtataggaaaaagcatagtgtgtagggttctgtactatctgcggttttaggcatccactccgggtcttgaaatgtatcccaggcagataagaggtgtttactatagttttgagtaatgaagggaaagaacttgggaaccaaatggaaaagaagctgagagcttacttgccaccagggggcagtgtaggccgtgggaactccaaggccagcaagctgaatgctttacaggattccttctgggttatgtttctttgatgggggtagtttcaggtttagctgctgcaggcaacagatgaaagaaaagctctggggatgtgtcacagacatgatgcatcatggaagggaagaatgaatttgttgaaagaatttggggttaggcaggctgggctgttgcggaaatcactcgacaagtttcagggacaatgaaggctgctttaggtcaagatgttatatgttccccacccacaatttcttattttgaattttttaaaatctacattgaaataatagtacaaaatataacaatacacaagcacaggccgggcgcggtggctcacgcctgtaatcctggcactttgggaagccgaggtgtgcggatcacccgaggtcaggagtttgagatcagcctggccaacatgatgaaaccccgtccctactaaaaatacaaaaattaaccgggcatggtggcacgctcctgtaatcccagctactcaggaggctgaagcatgagaatcacttgaacacccaggaggtagaggttgcagtgagacgagatcgcaccactgcactccagcctgggccacagagcaagactgtctcaaaaaaaaaaaaaaaaaaaaaaaaaaaaaacaagcacaaatttcatcagccatcagagcaattatgtcactataggtcatgaaacttttagaaccgcgcccctctcccccaaatgtttttggggaatgcgagtgaaaatgggcaaaaagtccaaaaatcgttttgattttgcagaatgtcagggttctctaggctatactttgagacttcctcttttacaaaacctttgtcacgtctaacaaaatatgcagtaactttttttttttttttttttttttgagacaagagtctcgctctgtcgcccaggctggagtgcagtggtgcgatctcggctcactgcaagctccgcctcccgggttcatgccattctcctgcctcagcctcccgagtagctgggactacagacgcccaccaccacgcccagctaatttttttttttgtatttttagtagagacggggtttcaccatgttagccaggatggtctcgatctcctgacctcgtgatccgcccgtctcggcctcccaaagtactgggattacaggcgtgagacaccacgcccggccaatatgcagtaactttatatcattattaaatattcagctgtgttcagatgtctccaattacccgaggaataatttttacagctttttttttcttttttctttctttttttggtagagataggatctcaccatgttgcccaggctggtctcaatctcctgggctcaaatgatcttcccctctcggtgactcaaagtgctgtaattataggtgtgagccacggtgcccagcctacggctgtttttaggaaccaggatacaattgagcttagtgtttggccattatgtctatttagtctcttttgtgtgtgtgtttgtgttttctttttccttcttttctttttgttttgttttcttttttattatttatttattattttttatttatcaaaaatctttttggatctagaacagtttcatatccttttgccccaggatattgacttttttttttgagacagtctcgctctgtcacccaagctgaggatattgacttttgttttttgttttttttttttgagacggagtgttgctctgtcactcaggctggaatgcagtggcatgatctctgctcactgtaacctctgcctcccaagttcaagcaattctactgcctcagcctccccagtagctgggactataggcatgtgccaccacgcttggcatgcttggctaattttttttttttttttgaggcggagtctcactctgtcacccagggtggagtgcagtggcgtgatctcagctcactgcagcctccgcttcctgggttcaagcaattctcctgcctcagcctcccgagtagctgggattacagacatcaccaccacgcctgactaatatttgtatgttttgtggagatggggtttcaccatgttggcgaggctgatcttgaactcctgacctcaggtcatccacctgccttggcctcccaaagtgtcgcgattaggcgagccaccgtgcctggcttcggctaatttttgtatttttagtatggatggggtttcaccatgttcaccagtctggtctcaaattcctgacctcaagtaatctacctgcctcggcctcccaaagtgctgggattacaggcgtgagccaccgtgcctggccgcatttaatacatttaacctactgaacattataggttagcctactttaccttaaagtggtcagaacatttacattagcctacagttgggcaaactcatctaacacaaagccttgtattttatacaagagtgttgaatatctcatgtaatttattgaatactgaattgaaagtgaaaaacagaatggctgtatgggtgcatggaatatgatttctattgaaagtgtatcacttttggcttggtgcagtggctcatgcctgtaatcccagcacattgagaggctgagatgggaggattgcttgaggccaggagttcaagaccaggctggtcaacatagtgagagcccatctttactgaagaaaaaaaaagacaaatgaaaaaaagaaataaaatgtatcactttcacattattgtaaagtcaataaattgttagtcatcgggcacatcacacctgtaatcccaacactttgggaggctagtgtgggcagattgcttgatgccaggagttcaagaccagcctggtcaacatgatgaaacctcgtctctactaaataacagtacaaaaattagctagacacagtgatgcgtgcctgttatcccagctactcagaaggctgagacacaagaatcacttcaacccaggaggccgaggttgcagtgagccgagatcatgccactgcactccgcagcctgggcgacagagagagactctatctcaaaaaaaaaaaaaaaaaagaaaaaaagaaagaaaaaaaagccaggcatggtggctgactcacacctgtaatcccagcattttgggaggatgaggcaggcggatcatttgaggtcaggagtttgagaccagcctggccaatgtggtgaaaccccatctctactaaaaagacaaaaattagccaggtgtgatggtgagtgcctgtaatcccagctactcaggaggctgaggcaggagaatcgcttgaacccgggaggcggaggttgcagtgagccgagatcgcaccactgcactccagcctgggtgacagagtgagactctggttaaaaaaaaaaaaatcataagtcagaccatcttaagtcaaggaccacatgtataccaagggttgagccacagggtatgtgtagatttagctttagtagaaactgcccagtaattttgatttgtagatgatctttatatattccggatccaagaactttgttggatccagtacaactcctttacctgtggtttcactttctgtggttttagttatctgtggtcaaccatagcgtgaagatattcaatggaaaattccagagataaacaattagtaagttttaaattgtacatcgttctgagtagcatgataaaatctcacaccatcccactcaggacatgaattatccctacgtccagtgtatctgtgctgtataggagtatgttacccattcgttaatcacttagtagccttcttgattatcagatgaaaaaaaaacatagattggccggtcacggtggctcacgcctgtaatcccagcactttgggagcctgaggcgggtgaatcacctgaggtcaggagcttgagaccagcctgaccaacatggtgaaaccctgtctctactaaaaaatacaaaaattatctgggcatggtggtgggcacctgtaaccctagctacttgagaggctgaggcaggagaatcacttgaacccaggagggggaggttgcagtgagccaggatcatgccattgcactccagtctgggtgacagagccagactccgtccaaaacaaaacaaaacaaaacagtatttatagggtttgtactatctgaggtttcagatatccactgggttcttggaggtatcccctgcggataaggaaggactactgtttatgtttgtaaatatcattttccactctgagggctaccttttcactgtctttttttttttttttttttaaggcggagttttgctcttgtcatccaggctggagtgtgatggtgcaatcttggctcactgcaacctccgcctcccgggttaaagcaattctcctgcctcatcctcccaagtagctgggattacaagcatgtgccaccatgcctggctaatttttgtatttttagtagagatggggtttcaccacattggccggggtggtctcgaactcctgacctcaggtgatttgcccgcctcggcctcccaaagtgctgggattacaggtatgagccacagcgcccagccaccactgcctattttttatttttaaaagtgtaaaacattgaattttatttcaacggtattgcttttaatgactgttgggtattccatttttatattagtgtgcttacctttttaaaattggtttgcaagatctgtttgtatattaagtatattgaccactgtgtggtatgtatatgttacaaatatattttcccagcatattggttctctttagattttgtttatggtgttgctgccattcagaaccttctgactgatcttttccttaatgatttatcactttaggtatcacatttgaatatcccttctgtattagtctgttctcatgctgctaataaagacatacctgaaggctgggtgtggtggctcacgcctgtaatcccagcactttgggaggccaaggcaggtggatcacgtggtcaggagtttgagaccagcctgaccaacatggtgaatccccatctctactaaaaatataaaaattagccaggtgtggtggtacatgcctgtaatcccagctactcaggaggctgaggcaggagaattgcttgaactggggaggcagaggttgcagtgagccaagattgcaccactgcactgcagcctgggtgacagagcaagactgtctcaaaaaaaaaaaaaaaaaaaagacatacccaagactgggtcatttataaagaaaaaggggtttagtgggctcacagttccacctggcttgggaggcctcccaatcatggtggaaggcaaaacaggagtgaaggcatggcttacatggcgacaggcaagaaagtgtgtgcaggggaactgccgtttgtaagatcatcagatcttgtgagacttattcactatcatgagaatagcatgggaaaaacccacccccatgattcaattacctcccaccggctccctcccacaacccatggggattatgggagctataattcaagatgagatttgggtggggacacagccaaaccatatcattccactttggtcgctcccaaatctcatgtcctcacatttcaaaaccaatcataccttcccaacagtcccccaaagtctcaactcatttcactattaactcaaaagtccacagtccaaagtctcatctgaggccgggcatggtggctcacacctgttatctcagcactttgggaggccaaggcaggcagatcagctgaggtcaggagttcaagaccagctttcccaaaataataaaaccctgtctatactaaaaatacaaaaattaggcaggcatggtggcacatgcctgtagtctcaactactcgggaggctgaggcacaagaattggttgaacctgggaagcagaggttgcagtgagccaagattgcaccactccatcccagcctgggtgacagagtgagattctgtctccaaaaaaaaaaaaaaatcaacaacaaaataaagtctcatctgagacaaggcaagtccctcccacctatgggcctgtaaaatcaaaagcaagtttagttatttcatagatacagtgggatccagggattgggtaaatacatccattctaaatggaagaaattggccaaaatgaaggggctgcaggctccgtgcaagtcctaaatccagtggggcagtcaaatcttaaagctccaaaaagatcttttactccatgtctcaaatccaggtcatgctgatgcaagaggtgggttcccatggtcttgggcagctctgcccctctggctttgcagggtacagccccactcctggctgctttcacgggctggtgtggagtatctgtggcttttccaggcacatggtgcaagctctcggtggatctaacactctgggttctggagggcgatggccctcttctcacagctccactaggggcagtgccccagtgggaactctctgtgggggctcccactccacatttcccttctgcactgtcctagcagaggttccctatgaaggcttcacccctgcagcacacctctgcctggacatccaggcatttccatacagcctctcaaatctagctggaggctcccaaacctctgttcttgacttctgttcaccagcaggcccagcaccacgtgtaagccaccaaggcttggggcttgcaccctctgaagcaatggcctgagctgtacttggccccttttagccccgactgggatgcagggcaccaagtcctgagactgcacaaaacagcaaggccatgggccctgcccatgaaaccattttttctcctagtcctttggacctgtgttgggagaggctgctgtgaaaacctctgacatgccctggagacatttttcccattgtcttggtgattaacatttggctcctcgttacttatacaaatttctgcagcaggcttgaatttttcctcagaaaatgggtttttttttctatcacattgtcaggctgcaaattttccaaacatttatgctctatttcccttttaaacataggttccaattccaaaccatatcattgtgaatacataaaactgaagtgaatgcttttaacagcactcaagtcacctcttgaatgcttttaacagcactcaagtcacctcttgaatgctttcctgctgagaaatttcttctactaggtaccctaagtcatctctctcaagttcaaagttccacagatctctagggcaggggcaaaatgctgccagtctctttgctaacacataacaaaagtgacctttaccccagttcccaaaaagttcctcatctccatgtaagaccatgtcagcctggacttcattgttcatatcactctcggcatattggtcaaagccactcaacaagtctctaggaagttccaaactttcccacatttttctgtcttcttctgagccttccaaactgttcaaacctctgcttgttacccagttccaaagtcacattttcacatctccttatagcagcaccccactttactggtaccaatttactgtattagtcttttctcatgctgctaataaagacatccctaagactgggtcatttataaagaaaaagaggtttaatggactcatagttccacatggctggggaggcctcacaatcatggtggaaggcgaaggaggagcaaagacctgtcttacatggcagcaggcaagagagagtgtgcaggggaactgccctttataaaaccatcagatctcgtgagacttattcatcatcacgagacagcatgggaaaaacctgcccccattattcaattacctcctgcctggtccctcccatgacatatgaggattatgggagctacaattcaagatgagatttgggtggggacacagccaaaccatatcaccttcctaaccagaggtcagatattatttgtatttttgttgttgtgtgtcacagctttgcggttttatttttcatgcatttaaatctttaatccacttggagtttactctgataatataagattacagcctgggaatctacattttttaccaaaatgtttatctagataagaccctggggtagggtggggctttgggggccagtttcatctagaaggcttcttggtgactatctctgtactcttccacccctgccaggcgttggagaccagggccagccctggccacaccccaggctgtgtcaccttcgtcctgaatgaccacagcatggccttcactggagatgccctgttgatccgtgggtgtgggcggacagacttccagcaaggtgaccagctcctttatccagcccaagatcttcatatagttacgtgtgtgtcaagtgttgaagtatctgttacaagaatgaatggatggacattagacttttagggggcttcagtattaaattcaaggagtttacctgctagaacagtggtccccaacctttttggcaccagggaccggtttcgtggaagacaatttttccatggaccatggcagggcatagtttcggggattcaaatgcattacatttattgtgcactttattattacattgcaatagataatgaaataattatgtaactcaccatcatgtagaatcagtgggagccctgaacttgttttcctgcaactagatggtcacatctgggagagacggaagatagtgacagatcatcaggcattagattctcataaggagaacgcaacctagatccctcgcatgtgcagttcgcaatagagtttgtgctcctatgagaatctaatgctgctgcggatctgacaggaggcagagctcaggtggtaacgggagtgatggggagtggctgtaactacagatgaagctttgctcactcacccaccgctcaccaccttctgcacagcccagttcctaacagaccacggaccggtacccagggttaaggacccccatgctagagtatgggaagagttagattcaggggcttagctgttgggggacagttagattcaggggtgtgttagttacctatttgagcccagcttgggcaacatagtgagactccctctctaagaaacaaatatagctaaaaaaaaaaaaaaaacaaagggctgggcatggtggctcacgcctataatcccagcactttgggaggccgaggcaggtggatcatgaggtcaggagttcaagaccagcctggccaagatggtgaaaccccgtctctactaaaaatacaaaaattagctggccatggtggtgggtgcctgtagtcccagctactcgggaggctgaggcagagatttacttgaacccaggaggcggaggttgcagtgagccaagattgcgccactgcactccagcctgggtgacagagtgagacttcatctcaaaaaaaaaaaaaaaaaagataaaaaaagaagttgttaaagccagcggtttaattgccagggagcaatgaatgatccatttggagtctagctgctaggggcagttagatttaggagcttccctgtagaaagcgagtatagtttcagaatctcagggttgggccatcctttgagcatgtgtgtgaatgtggggttaacactaggcctggaatttagctgtcttgtggggagaggtgaggctggatgagagggaaagacagaagccatgatgagatggccgtggaagccacatccccaggcctcttcctccctcttccctctctccttatctctgcatctcagtctctgtctttttctctccaaggctcccaatctcccatttatccattcacagtacagtcaggaagctgaaggatttaggccgaaatgcaaggtggaatagaggtttgccccctacttaggactcagagctgcttgtggggaccatggcttcacactctcctcctgggcctcatgtcctcatgtctgcagtttctttcttcttcttcttcttttttttgagacggagtctcgctctgtcgcccaggctggagtgcagtggtgcaatcttggctcactgcaagctctgcctcctgggttcacgccattctcctgcctcagcctcccgagtagctgggactacaggcgcccgccatcacgccaggctaatttttttgtatttttagtagagacagggttttaccatgttagccaggatggtctcgatctcctgactttgtgattcacccacctcggcctcccaaagtgctgggattacaggcgtgagccaccgcgcccagccttttttttttttttcttgagacagagccgcgctctatctcccaggctggagggcagtggtgtgatcttggctcactgcaacctccgcctcctgggttcaagcaattctcctgcctcagcctcccaaatagctgggattacaggcatgggtcaccatgcctggctaatttttgtatttttagtagagacagggttttgtcatgttggccaggctggtctcgaactcctgacctcaggtagtccacccacctcagcctcccaaagtgctaggattacaggcatgagccactgcacctggctttgtcttcagtttcttaccttctagtccaccttccttgttcagaacccttacttgacatcccctgggtgacagccaaggtcacaaatgacactctttggtgcttcacggtgtcattccaaccctatttacagccatgctgaatttcttgacattcctcaattctttgtatatgctgttccatctgcctagaatgcctttccctgttctctacttagacaaagggatattggcaggacacgaaggagagggtttagctatagtgattttatcctcctacccttttcttgaaggaaggggttagagtcttctgtcctgttgatccactgacctctgatctttccttccccaggctgtgccaagaccttgtaccactcggtccatgaaaagatcttcacacttccaggagactgtctgatctaccctgctcacgattaccatggtgagggcttcctggaagaggtgtggggcgtacataactttgaaagtggagtgtaaatctctgtaatccttgtagggcatgaagacgaccagtctcagaaatttctctggccaaaaaaaattaagtgtttgaggctgggcaagggggctcacacttgtaatcctagcactttgggaggccaaggcaggaggctcatttgagcccaggagtgagttcgagaccagctggagtaacatggcaaaaccctgcctctacaaaatacaagaaattagccaggcatggtggcatgctgccagctacttgggaggctgtggtagaaggattgcttgagcctgggaggttgaggctgcagtgagctatgattgtaccactatattccagcctgggtgacacagcaagcccctgtctcaaaaaaaaaaaaaaaaaaagagataaagtgcttgagcctgctgtgtgtggatgtagaaactatgtgactgccagatgcctagaattctgcagggcatgggttttcctgggccttacttgtggagcttagggaactgggggaaaactaaatttcccatagtgtccatggaggagggaaagcaattttaggaatattctgggaagagcccctgccagagaggcacccaaggcctcctggggaatgtagttctgagaggcctgaggcactagactccttgactttccttcccctcccttggcccctagggttcacagtgtccaccgtggaggaggagaggactctgaaccctcggctcaccctcagctgtgaggagtttgtcaaaatcatgggcaacctgaacttgcctaaacctcagcagataggtgagcagctggggacctggacttctgggtctgagagaggaggggctggggtcttggactcctgggtctgagagaggaggggctgggggcctggactcctgggtctgagggaggaggggctgggggcctggactcctgggtctgagggaggagaggctgggggcctggactcctgggtctaagggaggaggggctgggggactggactcctgggtctgaggcagtaggggctgggggcctggactcctggctctgagggagtaggggctgggctgggggcctgggctcctgagtctgagggaggaggggctgggggcctggggtcctgggtctgagggaggaggagctgggggcctggactcctgggtctgaaggaggaggggctgggctgggggcctgggctcctgggtctgagggaggaagaactgggggcctggactcctgggtctgagggaggaggaactgggggcctggactcctggatctgagggaggagggactggggacctgggctcctgggtctgagggaggagggactgggggaggaggagctgggggcctggactcctgggtctgagggaggagggactggggacctgggctcctgggtctgagggaggaggggctgggggcctggactcctgggtctgagggaggaggggctgggggtctgaactcctgagtctgagggaggaggggctgggggactggactcctgggtctgagggaggaggggctgggggactggactcctgggtctgaggaaggaagggctgggggactggactcctgggtctgagggaggaggggctgggggtctgggctcctgggtctgagggaagaggggctgggggtctggactcctgggtctgagggaggaggggctggggtactggactcctgggtctgagggaaggagtgggctcaggaccaaaactctagtttcctgaagaggaaaggttcctaggatttctgggtctccagtggggcctggaactctacctaggccccttagttttaaccttgatttcttcctttcagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtg

SEQ ID NO: 36522 - DNA, 164822 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtcagtgcgccccggggcccgcccagtgacacgtaggtggcctccggttacctgggtcggggtgggtgcgcgggagggcttgcgaggggccctcgaaattctcccaaaacctcgtcccgctggacttgcacctccgaggggtccctgcgcccctggggctccgcacctctcgcttcccactgacgactcggttgtcccccaccaccgggctgaggacttttaactaagtttctgtccagccgcctaacaaacgtgcttaacaagtaacaggaggttgtaaggcaagggagggacctggctttgaaagttgatggttttgaaatcgacggctcctttgacttgcgtaggactcctttgtggtgaatggatttaaagtttattcttgtttttctttgctgccatttggtctttgcaatgttaagagtgaaggcattcaggacttgctgctgcctgctgtctggggcctgaggttgtggctctccgcttctgctctcctctcttcatttttgttgaaatccgtggattttttcataaatgtgggtgctggcttgtttcactatggacgcgtcgtttcctatggggttagatagatattggtaaacataaatattgaaaatgtgatgatcacatattgatgatcacagcgaaatcctctattccttcaggctctaacagtttgtttttcacgtatttgcataagtgtgtttgctcagctaagcataattggtaagccagaggtctgtgattcagagtctgcagttctggttaaggggagactgtacacttggaaaatgcgaagttttttaagaagttattcccttgccggatagaagagtgggtcccaaggaaaaagggtgtattttagaggtatggttatttgaaccaaactaaacatcattaaaatacacagggaggtagaatgtcacctagttctttctgcccttgatttccatatcccagtaggagcgagtataattgccccaaatgcaaaattatgaataataatcagcattgtaagtatattaaggttgcatttttttcttgatacttgtctgatttgaggataaaaacaccaagtggcaagagaaggaggtagcttgaggcaggaaggcacgggcgaggagcgaggagggaaggctgggttgtcatcatccgagcccgcaaggtacaccacgtcccctagcggcgcgacctcagccagtcgggtcagctcagatcctggtctccgtctccccatccggaaaatggaaggggttggtgatcgttgctgttccttccagcttcccaaatagcgagaaaccggtgggaggttatcttattgtgttagagcagtaggaaaaggtaggagggggaagtgagaggtccagagggccaggaagatggaagaaaacaagcaacagaggatgcttggaggagaaaaattcttgagctgggagctcatttcctcttttttttttttttttcctttcctcaagggactcaataatacttcccccacctcagatcaatctcttgttacctttattatttaaagcttgtgagtttgcttagctaatgcactagggtgaggtcaaggtgatccttgcagtctgacttctactaggcatcacttgactcatttgcatcattgtctctcaagggaacagctcctgcccaggtctgtgggcactcagcatggatttcagtctccctgtgagtgatgggaaagaactaacagaggtaagaatgtaagtggcagccctttcgaaacttctatttttgttcaaacctaatattttccaaaaagtgatttgatttttttgttgtttcaaattataccgtaggctgcaaggttttactgaatctattccattagtgacctactggaacgttcaaagaataaaaatctcacttgctcagtgtttttgatacacagtgacattcagtctgaagtaagtgatatttagggccaagaatcatttcaaatgcttagtatggaaagttgcaatctgggcagaatacactgtatcattttcactgggaagctccaagtattcagcagataacagaactttcagaatttagtttgaggtcaagattttaatgtctgtgtttgatgtgtggcctgtcttccttttctttgatgttttggtatcaatatgcctacacccttgaggaacattatttattgtaaaagctgaactgtgatgtaataaaaacttaaacataagctcttggtttaaagtccaatagtcttctctggccttaagtcagcatcatactactgtttggtttcttatttttacatatcatgttaccctcttatttaaatatcccgggccaggtgtggtggcttatgcctgtaatctcaacactttgggaggctgaggcaggacgatcgcttgaagccaggagtttgagaccaacctgggcaacatagtgagactctgtctctataaaaaaaatagaaacattagctgggtatggtggcatgtgcgtgtagtctcagctacttgggaggcggaggagggaggatggcttcagcccaggattcaaggctgcagtgagctgtgattgtgccattgcactacagcctgggtgacagagagactctgtctcttaaaaaaaaaaatcttagggaaaactattatggatgtcttagaaagttgagagaaaaggaggtaattctatttcagcaaacaattattgaattccttccatgtggtagatgcaaggatggtgaaaaggaagctccagaaagaactgcaacacaggggggaaagatgcagtgagcctcacggttcataccgaatatgtatatgcagtgttgtgtaactgggtggtagctgtagagtccaagaactttggcatgccagggaatggagaattacgttttgattcaggggacgaatttataaatgtggcttgaagaataacatatcttttaaaagatgaatggtgggggaatgaagacaaagtgagagtgtggggtgatgaaggctggaaagttacgaagggacaaattgtgggggacctctgatgttattttaaggagttatgctacatggggatagggaggcaaggaggaagtattacataacctcaagatgtggaaagacactgagtaacacatattggggcagagtgaggggtgcgatgatggatggaggactgggcttttattccattacaatccgtgtaacttatggctgctacgttttaagacactattgcctgtttactcaaattatataaaggttgtagaataaactaataagtagtttcttcctccctactctccgcaaattgatagtgctttatacttttgagaaatttaatttagtaaaaattaatgatgctattgtgttatagctggaccttgtggagccttttgaacatgtggggttgaagtcattctgcaggcacagagctgtccaagaaaacattttttttcccctctcttttttgtttagggaagggcttgctggttaatgctaatttaaacatgactcttctggcagctggcattcttgaccctgtttatgttatacatggtatttaaccacagtgattgggtatttgcagcacagaagaaaaagaattattattagtttgaaaccggcattaatgcctctgtaaatgatagggcaaggcagtagatggaaggagagagggaagccaagtagcacactcggtactgcagtgagagatgacataaccatgagaattctttaagtttaacttccagtagaagtaacttgctttctatatattttaaatccctagagctaaagcatttaactcattatcttcactctgtgggatccatttgggagaggtattcaggagctttataggttcacacttgctccccagtacctctgtgtcacaggaggatatacactggttttcagttgcatgtcagaggtggaactgacttggatgtctttgaattgctgttgaatctggagatgctagggtacccaggagacagacaggaaaaagaagaggctgggcacggcggctcatgcctgtaatcccagcactttgggaggctgaggcgggtggatcacctgaggtcaagagtttgagaccagcctggctaacatggtgaaaccctgtctctactaaaaatacaaaaaattagccaggtgtgatgctgggcgcctgtaatcccagctactcaggaggctgaggcagaagaatcacttgaacccaggagggagaggttgcagtgagccaagattgtgccattgcactccagcctgggcagacagagtgagactccatctcaaaaaacttaagaaaaagaaaaagaaaaagaaggtggctgaatttctttcaattaccttgtgaattcaatttaatgaatgatcttcccagcagtttgttttatcttctgcaagggaacttatgtttggcatgtttaataaattaagttaattaagttggagaagcccaaggttagtatactttattttaggatacatttttggtaggagaggaggaggggtggcatggtggtggtgatgattttatttaaactctttggcattttttagcaggttagtatgatttcaaagtagtgttgttgttgtattatcaacttgtggggctgggccaaagaatattgtcttaatacttgcatgtccctgtcatctaatcagtgctatagaaactttaaccctgaagtccatgtaaaattgtaattatttttttccagaaatgaaagagaactattttactacattcatggatttaggttataatttattttatttttgtgatactgttttaaaaaagtgatataatgacagggcagacccttaactttagtccagtgctaaaacaaacgtgcaataagcctgcatgaggcagggcaagctgtgtttgttgtattatgaaaataaaggaaaatgttttcaaaaccagcatttttctctaaaagaaaaaattttgactaataatacctggccatgggtgggatttccagctgttggttgaaggaaattttgttcattatggccattatgtgtgctatgtctcttagagtttaggatttgctatgctgagattgctactgtgaaccattcctgttatagcaagtttccctatattcattaacttatgtgtctaaacaatgctctagattagactttatatcgatctgttctactaaattttcttcccctatgcctaggtggttctctttgaccaacccttaactgccctgattctgaaattctgctctaattgaaggatattcctgggtctttggagggagaaatggttcaggggcagaggaaactttttttccccccatctcaggagcacttaactgactgcctgctatataccaggctttgtgctagttttactaggggtgagtgtgaataaggcaggattcccaccctccaggaggagcttacacacgattaacagataattacaattcagtgtaacaagtgttatgagagagaagactttgcgggagcaccaagcgggggcacttgaccctcagcggtgaggtggtggaggtcagggaatgctcctggaaggttaggatctggaaggatcctgggagataaaccaagcctagaagaggtaaaaaagggatcaagaggctttctatctccagtttcgctactcctgggtaggtcaaagtgcctctctttttacatctggaaaataagaataagaactgatatctggttggtaattctagttttcatttactatgtgttccttaatcctttatattactctttcttccatattcagtaggcatttgtacccaccctgtactgggaagatagcactgcaggaaacaagatgtggacagaccccttctctcatggagcttgccctctatcatatgacattagtaagagaagttcttttagaatgccttcaaactcaggcatatgtatcttgttattcttccattttaggaacattttctccaaggtagtctcaatactttgaggtgagttggcctttcccttttaaggaaggagaccacagagcccggtaatctccttttcattttatatgcttgaaatattttgctaggatttatctgttttaaagtctagagatagacatagctgtgttttatctgtagccctgccttgcttccatctcattttccctattcttacttttaacccaacttgtgtttgagattctttgctcagtatatagtttgctttctagaataattcaaacctagtgcctgtagaaagtcagacttattttttatttatttgagatagggtcttggagtgcagtggcataatcctggctcacggcagctttgacctcctgggctcaagctattctcccactacagccttccaagtagctgggaccgcaggtgtgtgccgctatgcctggctattttttttctttttctttctttcttcttctttctttttcttttctttttttttttctttttttttttttaaagaaatgggctctcactacattacccaggctgttctcaaactcctgggctcaagggatcctctcaccttggcctcccaaagtgttgggatgacagctgtgagccaccgcatctggctaatacttattttgaagtcaccctgtcatggtgctttgcttcactaatgtatttcacttatgatcttgaagtcactcagggatacaaacacaataaaatgcatcccaaccaggagagggtagctgcattcatttacaaaatttttttttgcaatgattcaaacactatagatgtgtctaaagtaaatgtaaaaatctctctctgccactttaaccttacccatctgatatcagtttgttccatagccttccatagttgtccttttacttatacaaacctacaaaaattaatatttatgtatatttatgtgtgtgtgggataagtgtggatatgtttatacatactcatatgtatgtttgtgtgtgtatctgtctgtgcctgcctccattttcttttgctttagagaggctatacttgaggctgccatcaagagtgagaagtttgaagctggaagagcctgcatgggcccttcttgaactggtgcagcatgtgcagcatgacatcactcaagagttcttgtcagagtgataatgaatgtctggctattgtaaacgggaataagaaaactatttccagctgtgtgacaaccaagacgacaaaaagcattgcagagaatattattgccacaaggaccctgcttcatctgggtctcagacgacgggaggaggggcattttggagcacgtgtttggcatctgtgaaccttttgttaggtagaaaacaaggcctgaatgaaaggcctttcaaccacttctggagcagagaagataggtagagttactcattataggcaggtttcattgtaggagtattcagtgaggacccccgccttggaagtctgtaatcagcagatgataaggatggtgtgttcttactaagagaataacacaactgaaacagaattgccttttgttaaggggatgctttgccttcttggactacgattgtggggagaaggattattgtcaactaagtgaggcattcattctgtacccactatttattgtagttccacagagaactgcttgctttactttctgactaggcacagaaaagtaaaggttcaaaggctagggcaagatgactgacttttccagatttagcacaatctgttctctggtcactttgagacgctgtcagtttagtttcatgcagctgatatcttggagaacttctgtgtccttacgtttggctgaggacactaaatttttttttttttttttttttttttgaggcagagcctcactttattgcccaggctggagtgcaatggcacgatcttggctcactgcctcctgggttcaagcaattctcttgcctcagccttccaagtagctgggaccacaggcgtgcaccaccatgcctggctaattttttttgtattttttggtagagatggggtttcactgtgttggccaggctggtcttgaactcctggcctcaagtgaaccacccgcctcggcctctcaaagtgctgggtttacaggcccaagccaccgtgcctggcctgaggacactaaaattaaaaaaaaattaagaaagtacggtccccgctcttgagtagctcatgaacatggagcgatatggactcaaatgattaagatcaggtaggtagtgatgaatacggtaaaccaagtttcaaacaaagagctgtctgcatatctgaggatggagagggtaagtcagccttagaggagggaaatgacttgcagcaggatgccagcctcaatggtctgtggagctcattccatgcagaagagtaatgaggaagacccagtgagtgacaggcttggggaggagtgcctgaaattgacggtttgtggcaggaagtggtgggaccaatctcgaagcttgtggaggtagaagggtactggagactactgtggacaaaaaagggcatgttgatgccattaccagacaggacacgagagcatgatgattgttgcagtgaggcttgttagttttagacatgtctaaaaccatgcaggcagagattttcagctggtggctggcaatttgagtttgaagtttagctgagaagtcagttggcagtattcaggcataattgctaaatgtagaagtaaatgccagtaaaatgtgtgtgataagctggagagcacttttagagtgaaaagattgatatattttaacaaggacaaggcttatttcaattctttaggttatttttctttagcagattaaagtagttttatcggttatcaagcatttgttgagcgtttactatggcttctcttgataggtggtcctggggagataggaaggaaatggtgcaaatttcaacaatacccactggggtgaacaaaaaatccctgaaacaccccattccagctattgttatctggaaaaaaatccttacaataattagatggtgatttgacgtctgggggaagttgcagatatagttttaatttactgtaggactagtggcagtgagtctcatattgctgtcatataaaaggtaaaccttccagaagaactttggaaatttcagtagcctaaagaccacgctttgagaaactcgtaaaggtttgtcatagaggttttaaaagtctgatcaaataattttaagctttagttgcctactaaaaagtaggatgcagtacaagtttgtcctttacttggtaaaaaaaaaaaaaagtctttttctaattaagaatttattttcaccttagataattttattggcatgcctttttgcatgcaagatagaaaaaagacaagtttattcttagttttcttttttctaagccattatgattcttttaaattatactcatttcaatttgataggaaaaaacagtatatgctcattttaaaatatgtggaatgtacagggattcatgtgtagttccatcacttaagattgactttcttgctaggcatggtggctcatgctggaaatcccatcactttgggaggccaaggtgggcagatcacttgaggtcaggagttcaagaccagcctggccaacatgataaaaccctgtctctactaaaaatacaaaaattagctggatgtgctctcttgaacccaggaggctaaggttgcagtgagcagagtttgtgccactgcactccagcctgggtgacagagtgagattctgcctcaaaaaaaaaaaaaaaattcttattccattttgggataatttcttgcagttttaaaaatatttgcttttacggaatatttaacagcattctcctttgtatcataagtatgtacacaggccattaaaatctttcatttttaatttctaatgactacatattagtcacactatttaatgtgtgtgtgactgattaaacatacctaattatgtttagtcattccctttctccgcttgcttcttttttttttttttttttttttttttgaggacttgtgcttctctgcccatatttcagtgttgatgttcccagagttctatccttactctaaatgatctccatttttgagcttatccacacagtggactgtggtttcctggtctttgtccttctgcctaggatgttctttcctaggtatccacatgcctgctctcattattttcatgtcttaactcaaaggtcaactttgagttaaggctttctatcactacatttaaaattgtgtgacctttcctgtctacccagcttgcctgatattttcttctccattgcacttttcttctgacttcttagatgaggacaggacttaaaaaaaattgtatttttattttctgctgtttccccaaaatatttttcttgttttgtttcttaaagaccatgtcttgttctgtcacccaggctggagttcagttgctcagtcatagctcactgtggcctcaaactcctgggctcaaaccatcctcttgcttcagcttcctgagtagctgggactgtgagcacatgccaccatgtttggttatttatttatttatttatttattttttgggtagagacagggtcttgctttattacccaggctagtcttgaactctcaccttgacttcccaaactgttgggattgcaggcatgaacgccgcacctggcctgttgatttggggtggagcgttctgaaattgaggcagtaattaatagcctaccaaccaaaaaaagcccaggaccagacagattcacaactgcattccaccaaagttacaaagaggagctggtaccattccttctgaaactattccaaataatagaaaaagagggactcctccctagtccattttatgaggccagcatcatcctgatactaaaacctggcagagacacaacaaaaaaagaaaatttcaggccaatatccctgatgaacattgatgcgaaaatcctcaataaaatactggcaaactgaatccagcagcacattaaaaagcttatccaccacaatcaagttggcttcatccctgggatgcaaagcaggttcggtgtatacaaatcaataaacgtaatccatcgcataaacagaaccaatgacaaaaaccacatgattatctcaatagatgcagaaaaggccttcaataaaattcaacaccctttcatgctaaaaacactcaataaactaggtattgatggaacatatctcaagataataagagctatttatgacagacccacagccaatatcatactgaatgggtaaaagctggaagcattccctttgaaaactggcacaaaacaaggatgccctctttcaccactcctattcgacatagtattgaaagttctggccagggcaatcaggcaagagataaaaataaaggatattcatacaggaagagaggaagtcaaattgtctctgtttgcaaatgacatgattgtatatttagaaaaccctgtcgtctcagccaaaatctccttaagctgataagcaacttcagcaaagcctcaggatacaaaatcaatgtgcaaaaatcacaagcattcctatacatcattaatagacgaacagagagccaaatcataaatgaactcccattcacaattgctacaaagagaataaaatacttaggaatacaacttacaagggatgtgaaggatgtcttcaaggagaactacaaaccagtgctcaaggaaacaagagacgacacaaatgaatggaaaaatattccatgttatggataggaagaatcaatatcatgaaaatggccctactgcccaaagtagtttatagattcaatgctattcccatcaagctaccattgactttcttcacagaattagaaaaaactacttcaaatttcatatggaactaaaaaagagcccgtatagccaagacagtcctgagcaaaaagaacaaagctggaggcatcacactacctgacttcaaactatactacaaggctattactggtaccaaaacagatataaagaccaatggaacataacagaggcctcagaaataataccacacatatacaaccatctgatttttgacaaacctgacaaaaacaagcaatggggaaaggatttcctatttaataaatggtgttgggaaaactggctagccatatgtagaaaagtgaaactggaccccttccttacaccttatacaaaaattaactgaaggtggattaaagatttaaatgtaagaactaaaaccataaaaaccctaaaagaaaacccaagcaataccattcaggacacaggcatgggcaaagacttcatgactaaaacaccaaaagtgattgcaaccaaagccaaaattgacaagtgggatctaattaaactaaagagcttctgcacagcaaaagaaactatcatcagagtgaacaggcaacctacagagtgggagaaaatgtttgcaatctattcatctgacaaagggctaatatccagaatctacaaggagcttaaaacaaatttacaagaaaaaaagaactccatcaaaacgtgggcgaaggatatgaacagacacttttcaaaagaagacatttatgcagccaacagacttatgaaaaaaagctcatcatcactggtcattagagaaatacaaatcaaaccacaatgagctaccatctcacaccagttagaatggcaatcattaaaaagtcaggaatcaacagatgctggagaggatgtggagaaataggaatgcttttatactgttggtgggagtgtaaattagttcaaccattgtggaagacagtgtggtgattcttcaaggatctagaaccagaaataccatttgacccagccatcccattactgggtatatatccaaaggattataaatcattctactataaagacacatgcacacgtatgtttattgcagcactatttacaatagcaaagacttgaaaccaacccaaatgcccatcaatgatagactggataaagaaaatgtggcacatatacactgtggaatactatgcagccataaaaaaggtgagttcatgtcctttgtggggacttggatgaagctggaaaccatcattctcagcaaactaacacaagaacagaaaacctaacactgcatgttctcactcataagtgggagttgaacaatgagaacatatgggcacagggaggggaacatcacccactgggacctgttggggggtgggggacaaggggagggataacattaggagaaatacctaatgtagatggcgagtttatgggtgcagcaaaccaccatggcacatttatacctgtgtaacaaacctgcacatgtatcccagaacttaaagtgtgtgtgtatatatatgtgtgtgtatatatatacacacacacacactcccatatatataaatatatataattatgtatatataaatatataaaaatatgtatgtatatataattatgtatatataaaaatatataaaaattatatatgtatatataaatatatatataaatatgtgtgtgtgtatatatataaaaatatgtatatatatgatgcccagcacactgaatgtattagctgccattttcattatcttcattggtaagttgaatcatatgagattgctggtatttgactgctcttgacctataaaatggtagttttgtacggttcagtctaatattacgcccttcagatttatctggccagttgcatcttctgcatttcctgagttcaactcaggatttttttctacatttgttagagaatctatcttgttgaagttcaaaaggtgtggtatgcattgtgcatatggtccaagaacatgcttcttacccattttttgtactatgtagttagtggaaataatgccttgactttggctgctttttcctcgtatatttttagtgctattgccaatttttgtctttgtgtgcaccttcttgagcattttaactggaaattgtgatgagttttattgggacatttagttcagtggctttcaaactttttagtcatgacccatagttagaaatgtttgtccatacatttgaatgagacattagttgtatatagtttactacacatagtaaactctgacattttcttttctattttttcctatgataatttgttcattttcattttaaaaagtactggttataactcatacattttgaaaacacttatctagtcatgaactgcagtttgaaagacactgatctagtctgttgctgtgctgtctaaaatcaggttcattcatttttcaacatccatttgttaaatacagtatcggttattttgctagtagctgggaatagagtgatgagtaaagcagtcgttatcactggtggcatgaagcatagagtctagtgggatggagcatatgaaccaaaaaaaaaaacatccaaatgtataaatactctgcatgataaattctgtgggggaaaagagcaaaagcgattaaatggggaacctcatctgactttgggggtgattcaggatttccctggggaactgacatttggttaggtctgcagatgagaatgtgttaactctgtgaaggactgagcaggggtgtgtgcgtgggattgcagagtcatggaagaaatagtaacagaagcaaaatagaaaaccggaagggaaagacaggtggaaggcaatcttctttgatgagttggcattttttgtgatacttagtaggccttcctgtttgtggcttttttttcttacttgacaaaagtcaaataggaatgtcaaggattttttgggggagatgggtgttggtgtttgttgaagtagttttgtattagagcaatatagtatattgctaaatagcagggttttttttttttttttttttttttgttgagacggagtcttgctgtgtcacccaggctggagtgcagtggcgcgatcttggctcactgcaagctctgcttgccgggcacgccattctcctgcctcagcctcctgagtagctgggactacaggcacccgccaccatgcccggctaatttttttttgcatttttagtagagacagggttttaccgtgttagccaggatggtctcgatctcctgacctcgtaatccgcccgccttggcctcccaaagtgctgggattacagacttgagccaccgcgcccggcaatagcagggttttttgaaggcttgctctgtatgaggagctgtacaaagttgtgttcgatatgcaggagaaatagatttggttggattaaaaaatacttttatataatataattaccaatttagtaactatgcataatttgtaagaaattataacactgaagttaagttttttgtaagtgaagatcagatggttgggtgagtatttcattgcttcttgttgatttgaatataatggtaagaattattactgcactaggatttttgttttttttaccttggtaggattttagtgttcattccccccaccctcttttaaaactgaagagtttaaaagaaagattttaaattagaagtccataaagtaagttggagaccacgtgagatgggagaccatgattcaattgccagttcttccattgctgtgcatgatacccttgacaatacccaacctttgaggccctgggagccttgtcttaaaatggaggacttgaaatcagtttgcaagaatcattctcccagtcctattattagtattaagtgcctttatgctttctattttcaactttgctctggctgtttaaagacttggcaccccaccatttaactaacctagtccaacaagctcaggccaaacttgggagaactccaggtatttgcatctttctgtgtctttgtggggtcaggctcaggtggcactaattccttcacattgggcaacactactaatgcttctcattacaacatggaagaatgggtaaagattagaattctcttgagacttttttttttttttttttttttttttgtgacggagtctcgctctgtcacccaggctggagtgcggtggcgggatctctgctcactgcaacctccacctcccgggtggttcaagcgattctcctgcctaagcctcttgagtagctgggattacaggtgtctgcccccacactcagctaatttttgtatttttagtagagacagggtttcaccatgttggtcaggctggtcttgaactcctgacctcaggtgatccacccacctgggcctcccaaagtgttgggattacaggcgtgagccacggcaactggcctaaatcttttaagactttatatcatagtttgcagtttgacaacacttggaattaattttttttatcctttcagattcagcaaacatggaaaaatatgattatcttatgtttatatgctggatgcttgctttggagaaatatgcagcatctaagttatatatattccacattttataaaaacccattggatgagggtgatattattttaaaaagattttaaagggctaaggaatcatatggaagatgaattcaattttaatgactacaccaagtttaaggaatattttataagaaatgggcttatgtgaaagagaattaaaggtacttggcaattcagcttatcttttctttttcctcctagctttattgatgtataatgacaagcaaaactgtatttaagttctacttatgatggtgatatacatatatactgtgaaatgagtactattaagtatcgtcaccatgctgtacgttagatccccagaacttactcataactggaagtttgtaccctttgaccagcatcttccctttcccccatcaactcagcttttcttaccagtatattaaatcatttgattcaaatacatttcaacattatttttttgtaattcaatatattcagtctttcaagttcatttattgtaacgtgaatatgttattacactcgttcttattttttgtttagaaatcgagggaagaaagatgagatgcatgctttttctgtttgtctgaactctgctgaattcctcattcatagtaaaatatttactcaggaagtccaggtaactctggagattttacttagtgtgttttggtgctgattcatcagttgatttttttaatttgttgttaaatatcttcttaagctgattattatatggaaaccagccaggactccaggctcctgatctgagacaaggcaggggcaggtcacacaggcacaggcaatgtttggcaatgtgtaggtccaagtaggtactaggcacaggtgctcaatgctagtactagaaacaggttgggtgtgaaggggctggggtcatggggttagggtaggttcaaggtagacaaagccaggaagaggcacagagcatgtagatgcctggcctagaattccataaaaggcattctggatagccctaagagagaagtggtgtagacaaaagtctaaagctcccaggagaaatttattttcagagttggaagcatcagttgaacttcgctgattgttcaagggaatctcaacactcaagcaggggtttagtcaccatgaccttgggacaaagtcccagcttctcttcaagtgtttggtcatcttaaagtagagggctttgaaatcacaaattctcatctgattcagggattaagaaccttgttgaatactatttctctaggagcaggaattagctgaggtctcatgactaaatgtattctttctacaagagatttattataaaacatatttaacatttgctatggactggattttctccctaatattcatgttggagccctaacccccagtgtagctgtatttggagataaggcttttaggagataattaggattaaatgagattataagtgtggggtcctaatctgataggattggtggccttatgggaagaggaagagagagatctttgtttctatacacattcaccaaggaaaggctgtgtgagcaaacagtgaaaagacagctgtctgcaagccaaaaggagagccctcaccagaaaccaaccatgctggcaccctgtattacatttctagcctctagaattatgagaaaataaatttttttcatttaagccacctaacgtatggaacttttttttgagacggagtctcactctgtcgcccaggctgatgtgctgtggcgtgatcttggctcactgcaatctccacctcccaggttcacgccattctcctgcctcagcctcctgagtagctgggactacaggtgcccgccaccaagcccggctaattttttgtatgtttttttttttagtagagacggggtttcaccatgttagccaggatggtctcgatctcctgtccttgtgatctgcccgcctcggcctcccaaggaactttttaatggcagcctaagctaatacaacattccactaatttgggtagggaataaaagtaactctgtccagtagccgttcagcagaaaacacacactatcatttacctgcctaactctcttcctttttccttcttcatcccgttttagtggcagaatgactcagtgagtaaaaatgttccagtgaacacatcttaaagtatttaaaactgttcaacttatttaaaaccaattgtttttatatgaaatactgtttattatcttttaaaatatatctctattattattatttttaatagagaaggtgtcttgcgatgttgaccaggctggtctcgaactcctgggctcaagcaatcttcccaaagtgttgggatcagaggtgtgagccaccatacctggcccttagtgtattcttaaaaacattaaaaaaattatttttgaaatcacattatggcaatatttaaataaacccacttgtatttgcagttccctaatgaatgtatttgttatttagtcatgttagttttatggcctatttctattatgttctattttatggtctacttctacctagaagtaacaaatgtgtgtttttatttctactgattgttttttaacacactgttatataaggcgatatagtctgaatcatatttttaatagcctgataataatccattaagctgttaaactgttcattcaaccattgccctatttttacacagttttatttcctttgtacttgctgttttaaaaagtattgtactcaacaacttttatgtaatttccgtagactgattaagagtgagatcactgatttgaaagtaatatcatttggtttccaagtagattttaaaaggtagtttaaaaacttaactttcaaaagtaacacctgtttgtgctcattttagaaaacaaagaaaaatataaagaagaagaaggaaaaagtacccatactccccacctagagatagccattgtcaagtttatgggatattcccttttaatattttctctgtaaattttatctagttggaatcctactgggcataatcagtactttgtcctttctcttaatagtatgcagtaaatggaagtgatgttaattccattcagctactgttatagtgaactcacttcagtaaatatctttgcaagcctatttttgcatttcaggtaatttctttagagtagattcctggtaatataatttgttgccttaaaaggcagggatgatttttatggctagagatagaaatgattaaattgatttccaaaacaatgataatgcttcatactcctaccagcagagtttgagaaaaacttaaagatggaaattagtataagtgaaatgtgaaatgattagagcaatgggaaactttaataataatctgtcctggatgacattgactagacctcattggtggatgttctctccactgtggtcatgtctttcactcatccacagttttgtcttctaacagagaactttatgtttcaagcttcccttagttttatgtcctttaatatgctgtgaaaaagtttttttttgtttgtttgttttgtttttttttagacagagtcttgctctgtcgccaggttggagtgcagtggcgccatctcggctcactgcaacctccacctcctgggttcaagcaattctcctgcctcagcctccctagtagctgggactacaggcaggcaccaccatgcccagttgatttttgtatttttagtagagataggtttcaccatgttggccaggatggtctcaatctcttgatctcgtgatccgcctgcctcggcctcccaaagtgctgagattataggcgtgagccactgcgcccagccaagctttgtttttaactgtatacactgcatcaactgatggtagggtattcctgatgagtatacttctgtgaaataactggttaactactagaaaatggagcaagtgctctaaaaatgaatagcaaagaattaaaaactaaatggtaattatacctgtgctggtttagtgtgtattttgcatatttacccgcataagctcaattttcttctagatgccattgatattacagtcagggaccacttttgtgccttggggaaataaagtgagcttccttaggaggtaatagatttgcaatttcacccattactggaagtagtcacatgtaatccaattaaatttgatatctcattagtgatggaggcccaccttcaaaaaactcagactcgagggatgggaactgaatgaaggtaccatgtgataaatgcaatgttataagttagttgcatgtctgttttcctactaaatatagtgaaatttaataagcataggaaggaaatggggtaagaggaagtgagtgtgaatttaagcagagaccgagaccaagggcccaccttagggtgctattcatgtattagaaaagggccacgcattttgctgttcttcctcatagttgacatgaagaggggactcaatgagctgtgttacccagaaagcccatgaagataaggactaaccaggggggacaactcttcatgtgctgggaggagaactcttcatgtgctgggaggagagaggattttatccatggttctccaaacgttaggtactttaatgtattgagtcgtgtctccaaatacaatcttacaatgaatgtgacaatggggttaaaaaaaactgtattgctcaatataggttaatggcataatgccaattgcttatctcagaaaagccattctgtaagagccaaagcaagacagttcagacaagcagctcactgctggctctgtccaagcatagacattccacattctttgtggagtgctgaattagatacttttcaggatgtttcctatgaatattacttcatgcaaaaggatatttttgataagaactgagtagcagtaagttcaaggttattaagctcaatactgcatcctctctttgtggtcagttaagtgtgggttcctgtgctttaagcattgacttgactgagagtagcatgaacaaagatcagcctatgagcacggattttgtggagtctttttacttcagggagtagaaggaagagaaatgaaggctctgacagttgatgcctttggccagagtttgcaagactggaagtctatgtgctaaatgaatttggccccacatacagtttatttgttcaggtcaagtttcaaaagtcagcatagacaggtgggcattatgattgttcctcgtgcaagtgtagtttctgtatcatggaagctaaagatctgttttcattggcacttcatgtatttatgatacctggttggtccctgtgggtatttgtgcttgtgacatttgctggtatatggtcacagtgtaatgatgtatgtgtaagttcagaagcagcatagaggaggtggtgattaatctgggtggggaataggacccataaaaggcttcattgaaaggctgtgactggaaagatgagtagatatttgccaggcatagaatttggacaagggagggtattccaggaaaagccaagtgcatatgcaaagacagctgtgtggattagcattatatgttaggggatttctgagtagatccaaagtgctggggcttaacaagcaaggtgaattatagcctaagccagaagtacctgaaggactcagtttgccgtgcatgaggaggctggccttggggcaatggggaaccatgggaaggtttgaaacagatcattgccatactagatttctgttttaggaaggttattctccaaacacccaggagaaatagttgcaggtagaagggactagaatagctttttaaaaaaagttatttatgaaaacatctttatttttcctccatttcactgacctatataattttttatggtgagacgtttgaaatttactcttattttgaaatatacaatgcattattattgactctagccactctgctgtgcagtggatctcagaaagaagctattcctcttgtctgtctgaaactttgtgccctttgatcaacaactccctatctcccaccccactgttcttcatcccttgcctccagcctctggtgaccatcattctaccctctacttcttggttcaactttttaagattctacctataagttgagatcgtatagtactgagatatcttaagagggcttgagttaaggcagtaacagtgggtttggagggaagaaggtagatacgaaagacatttaggaggaagaattgatgcaacttggctattgaatagatatggtgggtgagggagggggaggagtgatagtgaatggatgacaataccgttgaatgagacgaagtaggagagagtaacaaggacatgggaagtgtatttatattagattgccagggctgccatgaagtcccacggactgggtggctgaaacaacaaaaatttattttctcacaattctggaggctggaagtcatagagaattgtgaggactgttttcttctgaggcctctctctttgccttgcatgtgatggtctcctccccgtgtcttcatgtggtttttcgtttgtacctgcctgtgtccaactttcttcctcttataaggaccctagtcatattggattagggcccactctaatgacctcattctaacttaattacctctttatagaccctggctccaaatgtggtcacattctgaggtactgggagttaggacctcaacatatgaatttctcggggggacacagtttagcctagaacaggaaggatgaagagtttggtacatgttgaatttgcaaaccctatggagtatgtagggtggtggtggtggttctataatgcatttggatgtgtgagaacacagcccagaaaagaactccagatttggtatttaaaatcatgggcatggataaaaattgtcttcaccagtaatacccaaccttggcttattttaagaacacctgggggagcttttgaaacatgccatgtgcagggggctcacttcaggccatgactcagtctttgaaagagaggccagggcagacacctggtcattctaatgtgatccaaggttgagaggatgggtctagtgttaagtgtagagaagagatccgaaagaatggctcggatcattcaagtggtggttggtaagagagagagaaggatgggaaggatgggagtttggggggcttcttgcctgatgttcatcaacttctccatgatggatgtgcaaactggggagttcctttaggggatttaaggcttggaagaggcgccgagagaaatggcagcactgatggcttctctttttgggctcacctgagattagaatgcattcattaatagtgacagctttaccttgtccttaagttttccccacaaggcctctggaggttgtgaatgggagcagaacaggcagtttggagtttaatcatgattgtggtgtcaaagggcagattggcagaaaggagcatgggaggtatcaggctggtgtgaggggagcccagagggctgactatggtatttaggctgggcattgtgagaattgaccttggatagggctggtgaacaggaaagaatggagggagcaggaggctgggtattttggagggctgaaataatgtgtatgagcacaaacagctgcatagatgcatagtttcagctataaagggggattttgaagtgtcacaggcaattctgaatgatgaggggctaagtggtatagtcaattcagaaactaacttgagaggtcagactgttgggtgtgatgaaattgcccttgataatgacttgcttgatgattgagttgtttgcaagagggaatgaaggttggggaaatttactagataacctttaaggtttcttccagcctcaggatttaacaaaatgtcattgttttgtgtcacggctccctgatcaccctttttttctttttctttttggaatcagaatagagcaatctgaaaaatgccatctaacaatcccatttttattgatcccattgtaattgtaaatgtttgacaggttatagcctctttaaatgcccttggaatccattaacgcatgtttcatagagttcacacagggtaaagtggtactttggtcagaacatggtttgctgaatgtcactgatttgtctctaccacacagctggcttctgaggcttataatgggcaattaggacaggaaggagttacttaagttctttttaaggtaacattaattagattcatctcttaccacatggtgagggtcatggttattacatttaccattttgggtttggtgtttaacctctttattgtggattggttggtcctggacattttcagatttagttttgtggtaggatgttttgtctgtagtttgcgtgtgtatttagaactggaatgaagtgtactttttaaaactacgaccccaacagcaaaaaggattttacaagcacttttggccttcattgttagagtgtcttcttgttctatgaggaaataaatttgatccttatcctggaattaaaaaaaatccttgaatgtattttttgttgttcttgttgcagcaaatgcagatatcagcgattttcatgacgagtttgcttatttaggggagaacattttctaaatcacgtaaagcttaacattaacagaagaaaatttgaaaattaaaattttaagagtgaaattctagacctttcacaaagttacaggctgaatccagctggtctgtcctgtccagtcacaggaattcccgcttactattaaacgaaattttccttccttcttcctctcctttctctttccttgccttttcctctcctctcttctggcatatttctctcaattgaacagtttcttagttttttaccaccaacctcaaaggatcaagtgtgaatgaagtaattgctttattttaggctctttattttgccccatcagccccatttaaaactctgtctcatcctcctaccacatcccagatattgttttcttctttaggggacaagcttggactggaactgaaagatgtgattaccagggtcttgttctaatcctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattcggcaagcataggataaggcattggttttcactgtttactgtcatcagaaatgccagagatgtgtatttaaatgcagagttttcagcctgctcacagtgttcacaattcagataatttgggaaggatccaggactctgcattttttgtttgtttgtttgtttgtttgagacagggttttgctctattgtccaggctggagtgcagtggcatgataactgctcattgcagccttgaactcctaggctcaagcaattctcttacctcagctacctgagtagttgggaccacagatgtgcaccaccatgcctggctaatttaaaaatttttttgtagagacagggtctcgctatgttgtccagcctggtcttgaacacctgggctcaagtgatctttctgccttggcctctcaaagtgttggaataacaggcatgagccattgtgcctagctgagactctgcatttttaacagacaactggtgggccacatgttctttgagaaacagtggatttggggactttagttattattattttccatctcacggtagcagcatttttcaaagttgggccaatttgaaatgactgttttatcaaactgtagacattttgttttcattataatgtgctctctaaacacctcatatccaaacattaagaacaagtgggcttcatcatattctggactggtcagaactagccagcaagggtactatattgtgttttaggtgtcatccttgaaggatagaataaatcagctgtcgtgttctcagtgaaaagtggaaagaagttttaaaggatctgcaaaatagaattatgagacagaggaaagaaagaaacagacaatctgatctctatcttcatcggccaggtaagatttgaagtgtttaaagaacgggattcagtttggttacaaaagagtagctgggtcccagggatgggtttttcagttaggataatctgaactacatttgagagagaatttctagcaaactgcctgtccaaggatctcatggctggccttggaaggtagtgagcttcccgttattggaagtgttccagcagacatagagaatagattctgcagtgactaaaggattggataagatgtagaactagacctcagaagttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggattgcctttgaagtttattatttgcaggtgtagaagctcttaagttttagtttgtagtgtttctaaaagtgaggcattctcttgaactgtctttgatgatttgatgttcatacattatgtctgctgtgaatttggaaagcactgcagaatcactttttcaaagatcagaggaatgtgggatagaataaattaagtttctggctaatatttggtattcttctttagggatatgctttcagagatctgtttctggaaggagaagggaagtcatgacattttatgtgaactcaactgggcaatgtgaggttttcctatcattagctaataatatacatttaaagtcacatggaagtgtgttgcctgtgatctgaatttttattcctaaataaattagagattaaaatctgtggtttccagttcaagggtagggtaccaaaaaaaattgtctgatgtgggtttttatgtcattaagaaaggcggcaacagctaagtattattggcttttcccttttcttggttgcactggtccttttcccttatcttgaaaggcggtagtaaatgttgactttttgcctctaattcacctcaatgattgtacattttaacatgttttaagataggtggttttagcccctaccttattttcctggtctcttgcttccactgctctggttcccaagaatcaaaattgaggccagatgtatgttaacatcaagaaactctgactggcgctcttgttctctccctccccagatattaatgcaagaagggaactaggacaccaggaacagccactgttaacattctcctataatttctgcctgttattcctctgcaagacctttatgagagctgaatgtatttttgttctgtgttttaaaattttaacatttaaaggcagtgctttcctgtcacattgtaagtctctgaaaacattgtatataaatatatagatatattgcatatttgttttcaattttaaagtgggattttcttgcacaaaggtttgtatacaattctatggccaactgacctatctatgtatccatatatatatatatatatatatatatatatatatatatatatatatattttcctaattatgaaatgagaaatgaaaatatgtaaagtgtaaactatataaacaacaaaaacaaatgagaatttgtaaaatataaaaatcatagtaacttagcatccataataaaatctctattagtgtttgtaagtaccaagtcttttcccctccatatttagacatataatttattcaattattgattagaaattataggtaaaaatcatccaaatcatgcaaattctgaaaaactagaaatagcagctgttaacagtattggtatatgtcccttcatatactcaaatacatatatatatgcccagtattattttctattaatttttaaataactttttttactataaaagtgattcatatataattcagaacccctggaaaatataaaaatgtaaacaaaaaatggactgaaatatttccactcaaacataaaccaatcatttttaccaattcttccaaatatgtacacttatgtctgtaaaccccacacttttcaaaaaataaaaatgacacaagtatatattgctttgtggctttttaaaaaatatttaggaatgtatcaaacatttttgtgttaataaatgctcaataaaatttgttttggtatgaatttttttttttaaatctcattcctgactctaaacctcactttgagatttcccatctgtgcctctgtgtaattcgtttgtagtgatggtccactttactaattatctcttcagttgcacttaatcagctgtattactcacctactgaatatctaatttgaaatactgtgtttttatatttctaggaaccctgtttctatttttattttaggaaccctgtttacatcttcttaaaagttgtaagtcatttttaatatattatcctttaatatgtcctcttttacttttaaacttattaaacatttttattttatagtctgtattggataatcccagtatctgtagactttgtaagtctgcttcgactgtttgttctttttgatgactcttgtaaatgttgacttgtttctgtatgtgctttgcgatcccaccccactccccattctcccaatgtaagctcatgtttctaggaactttttctctgggaattctttgagagcttaaggtgaatcagttcagaaagaatttgtgttttcttctgtttgatgcattaaaggcactctcaacccatgtccacatcaggttgaattattagcttgaggtttttgggtggctacaccagcagtaggaattcaggtcatccccagtttattaagggcaagtgtccggatataaattctcaggggcgactctttcctacctagatccatgtagatccatgtgtgagacagtcacattttctgaccctctccctgtgtgacttgggtcagtattttttctattagttcagctgttaagggtaggatgtcccagctttttgcagaggtctttgatctgacttccatttttcacttgatttctgcttttaaaagccaaaactcaaggtcacctgggattattgggatataatcggctgacagactccctagtttattattgttatttttttcttttccgagttgatttcttgattacttttgcttcttgggagattcatgacttttgccaacttgggtaaacatttacagaggtggaggtgtgtgcttatgtatgcatacacacacagcagttttacatgtttttgtgctagaagagttttcactgtattttgctcttagtattctgggaaaagacgtctatagtgtgacttttaaaatagcaggacatattttgtccttcaaatatattgttattaataagattttttttttttgagatggagtcttgttctattgcccaggttggagtgcagtggcacaatcttggctcactgcaacctccacctcccaggttcaagtgattctcctgtcttagcctaccgagtagctgggattacaggtgcccacgaccacaccgagctaatttttgtatttttagtagagatggggtttcaccatgttggccatgctggtcttgaactcctgacctcaggtgatctgcctgccttggcctcccaaaatgctgggattacaggtgtgagccaccgcgctcggcatcttaaattaataccacttctcgaaaccttagggttgctttcaatttcccggatatagttttgtaatgattgtcttcaataggtatgttagcacagattgctgtttcttttccaatgataaacatcttgaagtaggattgctaggtcaaagggtgtgtttgtctggcttttgatacatattgccaaaatcatccttcagggacaggatgagatttttccatactgaaacccctgatcacagtgctcgaaagtgcagcaacttcattaaactgaatattataaatttagaaagattatcaatgtgttgggggcaatggcattttatttttaaaattagattatttaatcactttaagttaggcacaattttttcttatgctcatcgatcatttgtatttcataaatttcttgtggatgtttatcaaccatttttctattgggatgctcatctaaaaatttacttgtttaagctatatatttaatacatataattttcgtttttaaactttaagaatgttaacagtttatgatgtgatataaagcattttttcaaatatgcatttgtttaatataatgaagctttgaatgtttaggtagtgcattaggccatttttatactgctgtaaagaaatacctaagactgggtaatttataaagaaaagaaatttaattggctcacaattctgcgggctctacaggaagcatggtgctggcatctgctcggcttctggggaggcctcacaaaatttacagtcatggcagtaggtgaagggggaggaggcacctcatgtggtgaaaacaggagcaaacaagcaccactgaaagagagagagaaagggagagaaggagtgagttagttggggtgaggtgacacatacttttaaatgacaatatcttgagagaactcagatcacttaccaccaagagaatgttccagaaccattcatgagggatctgtccccatgatccaaacacctcccatcaggccccaggtataacactggggattacatttcaatgtgagatttggttggagacaaatatccaaactattttaggtagttacctttatcagtcttttctttggccttatgctaaaatagcctcctctcaatctgtgactatataaacattctactgtattttcttctagatctcttaaggctttatttttcatactcaattctaatgcataaacatttgtttatgtgctataaagatttataccttatacccctgtgaatttatttgagttggcttgcctgtgtacctatttggaggtgtgatttggatcaacccaaattatttgggattttttttgtgtgttgagtctgtaacttttgaatatgtaattaccatggcatggaattggtaatatagatgtttgcacaggcaatggtgaactccaaattcatgatggaacaagcaggtgcgtgtgttaaggaagaaggaataagttaaaggatgtgccaagacagaaagttaattataatgcttaacctttagggatcatttccccaacattttgtatgtttctttttcttcctaatggccattgggaatggaatgtgtgggattgactaggaaggctcttgcatcatcaggattttcagtgacttgagaaagctgggaagattatattaccagcactttgtgtcttgtgtacagccttttgcatgcatgcatgaatgaagaaaatcatttgacaggaaatagttgtgttagaatacttgtgcttttgggcaaaccaattcttcagttcatttttcatttctagtggctatatgccttcattaattcctccttttattgttcaattaccctttattgagcactgtctatattgccaggcacactgagcattaggataaaaaaataattatagtgctggctttatcctcaggaagctcaaagtccagcagttgtctcataactgaatagggtttagtgtgatgaatgttatgacttatgtgcaaggtacagaggtgatggcatatagcagggcacaccaacacactgctgatgatgtgtgtgtggcagtgattaaggagactcctgagacatcagctggacattggaagattgaaagataaagggagttcaccttgtggataggcagtggaagaaggcattttaattgtgaaaacagaatatggaaggcatgaagtaacatgatgttttctaggaactccaggtagttttgttggtaaataatgttaagacttgctagtggatgaggcagaggctggatcaggggaggtcttggggaatgtacaaaggaatctgaagtttgcttcctccttcccaattcttctttttttttttttttttttttttttttttttgagacagggtctcactcgttgctcaggctggagtacagtggtgccatcacagtatactgcaacctccacctcctgggctcaggtaattctctcacctcagcctcccgagtagctgggactacacagtcacacaccaccacacccagctaatttttttcaccatgttgcccaggctggtctcctgagctcaagtgatccacctacctgggcctcctacagtgctgggattacaggcatgagccgtcacgcctggcccacctccctcccaattcttaacaattgaaaggatttccacaattttgttagatcattgcaggaggttaaattggagagagacagagagaaatgaaatgagattagagctagagaacttttttttttttttttttttttttgagactttgtcacccaggctagagtacagtgttgtaatcatggctaactgcagcttcgacctcttgggctcaaccaatgcttgcgctttagccttttgagtacctggaaccacaggcacacgccatcacacccagctatgtttgtttgttttttgtagagatggggtctcactttgttgcccaggcttgtctcaaattcatgggctcaagtgatcctcccactttagcctcccaaaatgctgagattacaggcatgagccaccgtgctcaaccaagaatggatttgaatctattaagttggaatgttggactacattctggaatgggatgcataattaagtatcaccagactataagtgtctgtggaattgattggtatggataagatggcctaaggagagtaagcagaagtagaataggaaagggccaagtacagagcttgggggtaagccaacatttcctagtcatcagaggaagaggatcctgcaaagaagcttgagaaaaggctatcacaaagttggataagaatcaagggagcatggtgttgtgagtagggcaaaattaaaacgagtgattaatgatgcaaaatgccaacagagggtcaagtaagatgaggacagagaaagaacctttttagaggtcagtgatcttaaggttttgagttggggtggaggaagccatggttcatcatataaaaatgtaaaagcaataagcacagtttcttcagtatcctgggccttgaaaagggaggatggggtaggggaacgagagagaaggaagaagttggggtcaagggagtactttttctttcttgaataggaaacctagcatgtttatattctgaggactgggaaatgaggagagaacaaaactgaagccacagaagagagaataattgaatgaagtaaactgcagtgcaaaacaagatgtggccaattgaagactaggatgaatgggagagatatcttgcaaagtcattgttagccaaaattggtgacggtgactatcactggaggatcaagacatgcatttcacaaatgtttatgagcacaaagaactatggcagctgtgtactgggtgaaggatggagccttgattatgccctcatggaatgattagtttttcttaagtctgagttgttgggatgaacttcattgaaatagttaatgtgactttgacactactaagagtatgaatattacatgttagttggaatagtggtccaagacatatgcaaataaattcagttatttctgagttatgaattctgagcccaattatttttaccattatatttttgtttctgtgagccatataaatctgagatacagctggaggtttgggggaataattcctaggatatgtggctgcaccatctccccttaactcccacaaagaatggtttggttttcatggtccggctccttgggatggtggaggaggaagcttctgacctggccacactgcattggctcatgggtgactgccctttctgtgattgcagccaccactttttagtccctgatccccaaataatagttcactgtacttatcttaccctccccaaagagaaggagattttccttccaaataagaaaactctttagggcatcctcagggatgcctatgtgtttgtaacacttttagcacccaacatagccctttctcttttgatttgtggttcactctattaagcaaattacattcattgtccctagagaatgggttctaagtagatttgtgtgccaccctgctggtctcactcttgcgggcttttacttgagatgcgagggtgcatgtgttgactctgtcttaccgtggagtgttctggcttgcctactaaactccagggatagggacagccataatcctgccttctctgtttgtgactgaatctctgtggtttaaatactttatataaaacttacacatttcagctgattaataacagctatgcaggaacattcaattctgaggcaattttaatgtagtcgttgataaaatacaaactatcataataaaactgtttaatttacagttgattccacaggatcaggggatttccatttcaaatgggctcctgatgatctgcctggattcccagaatttctcatctgggtatacaaattaggtttcttgtaaccaacacttcatattttatttatttattttttttgtagagatggggtctcaccatgtggaccaggctggtctcaaactcctggcctcaagcaattctcctgcctcaggcccacagactgccgggattacaagtgtgagccaccatgcctggctcccttcatattttaaagagaagttacacctacagcgctttcgacttttgatggacacatctttctagagcatagttcttgcattcctcttttactgaaagttgttaattgctttgttccattagccttagcaggaaaaatcctatctctggagttttaggtcccttggtttatcttaatttcgattaggaataagagaatacctacctattcagctctcaaacagcaatgaatattgcactgtgttcatcctcattacctcccattattagtttacattctgggacactttttctatctttaatgataagttcattcagaaatatgttcccacattgagccatacttctggttttgtgtgattaactttggcaccccatgagtagtgtctgttaaaattaaatgcttgttttgcctcaagagagctagaatacatacacatattaccgtgatttactgttaagtgtgcagattgaggtggtttagaagtttaaaattggtttccgaagggaaatttacaagaaaagtataacagatgaatatgtgattagaactgcattccttttttaagtaaattaaacagttttattatgatagcttgtattttatcaatgactacattaaaattgcctctggaattgaatgttcctgcgtagttgttattaatcagctgaaacatgtaagtgttatataaagtaaaaagagctataaaccaaggagaaagtctgaagatagaactttaaaaaaccactgttatttccaggtaaaatatttaatttccaaagaaggttagcatatgttaaaagctaaatcttgttctgcatttgttggctacatttatatgaatttttatatggaagttcctatccagggtatttattagtcattttggaagtttttatccagggtattgattagttggcatcttatatgttctttcagaagctgtatgtattatttttaaaaatagaattctaattgagcttttaatctgtctgctgaatcaggaacattacatgactttctttggaggggaaggaagccagtggttagttttaggtataaaagagatcttcaagcacggtctttttaacttcttgtttctgtattatttcaggaaatagaggcagctttccctacattagattgttagcacagaataacagtagaagggttcagaaatgaagctaaaaggaaataagagaccagcatgatgctggagttcccctaggccagtcaaattatgttcaggcctttagtccatctggatgttagttctatgtatgatatgaagttggggtgtctgattaggtatatttttccttttgccttagaaccatttttttttccagtccctttatgtccccactgtaatgtcatgtgtatcatttatgtaagactgttttgaaactttgtgtacctctgaatgtctagcctggaacaattgtcacattaccttcattacatggcttttaatatgtcttactcattggtaggtcaagtcctctacttctattctcttaatttgtcttggctattttggtccttagcatttcactggaaatttaggagcaggtttatctatagacttccttggactttgaatttaaataatcattttgattgcaaataagggcagttttgactctttcactccttacatgttatttattgttgtcttgtttcattgaattaactaggctgtctagaactgtgttgaatagtaggagtaatagtgagattcttgttattcctgatattgaagaaaatgcttctaaagagaaccctattcctttttgaggagtattatttaaaacagctcagcatttccatgtgtttgattttagcatattaaaacataggaaacatgcagtgaacaaaaggggttattatgagcttagtgtaccagctgtcttaaggttttcattgttttagaggcatttagttagatttaattctgactccaaaatgaccgacctctctggagactgtattttgtaggagagaataagagtatttccattttaatggaaaagtggcaaagcttccttccacttcgtaatttttgtggacagtattccagcattgtccaacagatttttgtgataatggaaaatgtatttctgcactgtgcacgtaggagagcaactatcatattggacagtgtgggcctagactttggagttctaaccatgccccatttactagctgcacaggttcctgcctggtttcagaaggcttattcttttgggctagcacagctcacactgaggcacgtggctgggggagtagagcagtccttgctggattgcagccatggctctccttttagcctgatgcctttgtgcaagtgagcagctggcaccattgacaagggtgatcctggtgactacctctggaggctctggaccctgactgctgaaacaggagaaaaccctggccccatgcccctaagaagtcacccgatcaaagtggagcctgttgtttccctagtcacaagtcaatactaagagatttggctagtgacaaggaaatttttcatgttagaattcttgtacccagctctttttagaactggactactgttctcccatattcaggaggccatgaaccaaccagtagattgtttattgtgcttgctgatttatgaaaaaacttctttgtacagagcttctgaaaggggtaagagaaagggagaatagcagtgttatggactgaagaatgtgtctccctgaaattcatatgttgaaatctcagtccccaaggcgatggtattaggaggtgattaggtcataagggctccgccctcatgaatgagattaggggccttataaaagagaccctacagtcggtgtgttgactcacacctgtaatcccagcactctgggaggctgaggcagaagatttgcttgagctcaggagtttgagaccaacctgggcaacacagcaagaccctgtgtctactattaataaatattttaaaaaattagcctggtgtggtggcgtgtgcgtgtagtttcagcttcttgggaggcttaggtggcagaatcacttgagcctaggagtttaagtctatagtgaggtagatcgcgccactccagcctgggtgacagcaagaccctgtcctaacatgctcttaggagtttcataaatgtgaccccagaagagctctctagccctgtttccacttatgaggctaaattgagaagatcgcagaccacaaccccgaagaggcctcatcagagcccaactttgttgtcaccctggtcttcgacttccagccttcagatctgtaagaaagaaatgtttgttgtttaagccacccagtctgtggtagctttcatagcagcctgaactgactaagacaagtggatagctgtctggttgttttagaaagcagggctgcatggtgtggggatgctgctgctactcattcctgctcattccagtgttctggaaaatgaggtagggtgggggaggtctgaaccttctaatttatttctagctgttcttttttagcaattaaagcattcgttggacaccagttgcttttaattcagttccatctgcactgtacttaatagatattactcccaggttcttataaatggctggttgttattcttggtttcagagctattttgagtttttgtcttcatttgtattttgactggaaattgggtgtggacatattggggagttggggctgacatcatctttattcagaagtcactttatgaccatgtgcgggatatattaatttcactacagcttttgatcttaataaaatgtctctgggttgagctgactgatcacgaagattttaaactttaatgtttcctaagaggattgatacagccatccagagaataacatagtatataggagttatcttttgacagatcaagttccatttccaaatgatataaaacccacctgtgtccacatccttatgccttcttttgaatctatgatttgataacttaagaaatctatctatgcattagatattgcctttccggtagagctatggtgtgatcttatgctcatgaacagaaaatgaatttaagaatcctcagacctattgtccagttcttttctttaagaagaacttgctattgactttgtcaaaactaaatctgttgccttgggcgacaccctccaaaattcagattcagatggattacactaatagctttatgctacagatcaagtcatataatgtgaaggtacaattgcagctcccttattgttgtagacgcttgccgggatgaagttctcaaacttaacatgctcttaggagtttcattaaacatgtgtgtgtatttttaatgtccaggatttataaatggtaacacctgccctcagttcttttttgcactggtccacggtgtttcagttacagtctttattgaataattcaaaagttctctcctgaaacaatatttctggcagtccttataattgaccaggtggaatgaccttcagtttggatgaaagtccaatttatttatttatttaataaaattccaaatttgccttttctgccaggtattaaaagcacttaaaactttttctaatcaacaatactgaacacttcagacacttatcagagactttagtcttgaattatgtattattttaaattattatttccagttctattaaaggccatgtgaggccactgattttttaaatggacagtttagtgagtggttcttaaagtgtggccccatgagcagcaccagcatcacttggagatttgttaataaatgcaaattcttggatccaccccagacctactgaatcagacatgcagtggggtggggctcatacatctgtgtttgaacaagccctccagtgaattctgtgtgccacatattacaatttgagaaccactggtgtaatgcagtagttaacacacctagctttcaacctagacccactttgggtgcttgttaaaatacagattcttggttctctctcgcacagcatcttatgcaccagctttggagaagacacaggactcagtgttactatattctgcagtaaagcttgctctgctcaccttatatcatattagatcacttactagcaataaatgtagaatataatacgtttgttctagtccaagtatctgtgaagaactctgatttaagataatggcatgtaatcagacatacgcttcagaattaaggagacttaaaaaatacagatgtctagtttctactaaataaaaaactctgttaaaagtctggttttgttttgtgtttaagtttcatgggtgctataccatccaagaaccatttatttttatcttcagctttcattgagagttgataggagaagaaatagccatattaatatttttgtatattttataccatttgataactcttactaggaattagtagaagaaaataacatctctctctctcaatagttaatacgcaactcttcattttcccttttgctttggttaccagagagctcagagtaaaattttgcactcagttttgaaatacctatttcccttgcttactttaatccatgactcttgttctttataatcttctgtaacctatctgaaacttatttggaagtagatggggccccaaaactaagtaaatgatggaatatctgccctttgctttgaaatgggcttcttgattgactctttcccagcttggggtcagtgtcttctttatatcatccttcctttcatagacacaatacaattgttggtagcctcactgtgaaagagttaatgtttcccaataccaggcactgacataggcagtaggaaaaatctggttcattttgtttcaaaatacaccataccacgaataagtacaaacagctgcaatttgggcttggggccaaaagaaatcagtgtggtgctatgaattccagctgagaggaggagttcatgtaacttagatcagagatcagtctctgtaacgagaccatcagaccccagaaggggaagggtccttgtatgtcacttcagttacctccatcgctaccaccaaaagaaactggggtagttctttggagaggtggccttttagaaatctaaaattatacccttggagccgcttctctgcaattggctgaacacatcacattttatcccttgcccccagcactgtattactgtaaaatggggaaatctgggaatacaaaagatttagagacttgccacctgctcattttatcgctatgacttggcttaaaacaacagtcgctgtaacctcagccctttggcacacgcttccttctcaagccccaggaaattcttggtcaggtcgcacccacagccactgagtctggttgtttcttcttctcccagattttttagggaatatcagtttagtaaaacttatttttttgtaagcggactccttttgtatcagaattcctttcctttaaaaaatatttttatatttattattattttttaagtagagatggcatcttgctatgttggccaggctggtctcgaacccctggtctcaagtgattgtcctgccttggcctcggagagtgttggagttacaggcttgagccaccacacccagcccagaattccctttctaatgtcataatgccttatctcttttttggagtggtcatcaaatcccttttcacactagttagaagttttctgtgtgatattctccattctctacatatttggactatcccactgtgtttttctggacatgtaggacagcatctttcaggcccattagcagatagaagtctttcaagtggggcctcacagctgtttttaggtctccggttggtttttaggtcatgtctcagacataggggctttgtggctactttgtggttttactatctcctcatagtttattaaaaaagaggctccttttcccttccattttctactgctttcctgataaaagacttcagccattatttttaaaagtgtccgctattatattttaaaccctttcataacaggaaaacaggagttaaccactcacataagttagagaggggaccccccttttttggtgattttcatagttactaaatcattgtgaacagagaaaagtcacttaattccctttgcttcacttcctgatttcttcaacagagtggtaacatttgagatgctattcatagaattgtatatcaaagaatgaggccagctctttcttggtgctccctcaagttggtaaaatcacgtatgtgacttctcaggaagccagagtatttacatatcctcgacccagctgggaataattcatcctctagtacaatactagttttctttagattcccctctatatttactgttttagagaggtattgccaagagggttttcaatgaggaagaatggtaatatgctgggagcaggaaaggaaatgaaattaagcgtctcattatttttcccatgctgaagtagatattaggattgtattccacaggtcttattttcttccccctccccacctcaaaacttcaggcaggatgtataagtctagacttaggttatatactgattttttttaagcttttatctccagtttaattagaggctggtgaaggaaactgggtttcttatttggctctcaaactttgaaaataaacaaaactttcatatatttgaatagcacattgtgggccaaacaacatctggaagagattagtctcactggtaggcagaagaaatttcataatgtaccatcttcaaagaacatggtacctcgtcacatttctcatgtgacatgtatcctggaaacagaagtacttagggccacattgctggagcatctgcctttgtctttgttttgtgtttaacataaatgtgtctttctaatactatgatatttctttagcttttttgaaaacacagctaaacttggtggtacgatgctgcctgcgctgttgactgtggtctagacttctcctttttcagaagacctatttgacttttggcaacgtgcctcttagagtttgtgatttgtttgagacatcttttcctgtcttctctaaaatcaggcacatatgtgtctggggtagtcatgtactttgtaacagtcacttttagccagatcttggggatgtctattcttatggttagtagtgacacatgaaccctctcttccacttaaaattattttatgtaagatgactgcttctccttctatccctgctccttcctctcctcctcctctactctgcctccctcaaacttatagaaaagttgcaagtacagtaaaaaagtgtgaagaagcttttatctccctaagtcaattaagagtgaattgtttacactgatgcgctaacatcttcaaatactctgtttttctcacaaacaagcacattcttcaacatagtcacaaagcaaccactgaaatcagtaaattcaccctattatcttactatcatctaattatcagatcccattgaaattttcccatattgtcacaacaatatccttgatagtgaaggatccagctcatcatcttgcactgtatttataattaggtcttttctaagtctactttattatggaatagtttctaacttttttcttggcttttatacccttgatctcttgattataggctgttcattgtgtagaatgttcctcagtgggtttgttacatgtttcctgttgattaaattcagatttcaaacttttggcaggaacatgacagaagtgatattctcattgcattttgtcaggtggcacacactgttgatttgctccattattggtgatgttattttgatcacttgattaaagtgatgtcttccagacttatttactgtacagttattattttgcactttatggtaagtattttctagggaagtgtttgagtctttgtaaatatcaattttttggtcaaacttttatttgtattaaaatgaacttacggattcctttttcattttcaaacttagaaataattagaccagtgagtacctttcaaactagtttccttgtcctttttacatgtctgcataattcttttaagtgctgtcttaactgtctgctcaaggtaaccaaggcatcatgtatttccctaatctgaggaacaggcatatctccaaggagcctggcacctttctgtagagaatggtattaagagacgaagatgtaagtgttaggtgtgctcattgttattgggatatcactattcccaggcttctcactgtgcaacacacacattgataactgtttttatttctatttctattgaaaacctctctccttctctcctggattacctctttctttctctcctggttgacccctcacctttcaggctttgacacaaactctgggctaccttcccatggggacatcctcttcacctcacttagactctgacactctgcgttgggctgcccttggagccactgaggaacattctacacaataaacagcctataatcaagagatcaagggtataaaagccaggaaaaaacttaaaaactattccataataatttttaaaaattagtttgtggtatgagaacacatggacacaggcaggggaacatcacacaccaggggcctgttggtgggtgaggggctggggaagggatagcattaggagaaatacctaatgtaaatgacaagttgatgggtgcagcaaaccaacatagcacatgtatacctatgtaacaaacctgcacgtggtgcacatgtaccctagaacttaaagtatattaaaaaaaaattagtttgtggttagtggtcatattttcttgtatgccagagttttccatttaaggagaatgttctttaaatattacattttaaaaagttgtaaaatagcgtttttctttaagacttatgctttcttttaattttttcattgataacatagactacatatatttaaagtatacaatttgatttgttttgacgtatgcatatactctcgaaattatcactgcaatgaagatggtgaacatatccaacactcctcagcttttctcctgttgtttgaaatccttccctcatgtcattctgctcttatactcccaggcaaccacttaattgcttttggtcactataaattagtttgcattttctacagttttatataatggaatcatacagtaagtgttgtgttttgtctggtttattttactcggcttattttgagagtgatagatagtattatacataccagtagttcatttgtttttattgctgggtagtcttctgttttatggatacataacaatttgtccattcatttatgaatggacatttgagctgtttccagtttttggctatttacagataaaactactagaagcatttgtgctcaagtctttgtatagacaactactttattttctcttgggtaaatacctaggagttaaatggcagaactggataattaacttttaaagaaactgtcagattattttccagactgattctatcttacattcccacatcagtgtgtgagagttgcagcttctttaaatcctcactgacacttggtatggttggttttttcaattttatccattctaatagtcatgtagtggtgtttcattgtggttttaatttgcatttttcctaattgctcttctatgcttatctgccatccgtatattatctttggtaaactgtcccaatcttttgcccctttttgaattttgaaatttcttatatgctttggatacaagttccttatggacatatactttgaaagtattttctctcagtttgtggcttgccatttaatttatttaacaatgtcttttaaaaagtaaatttaaatgaagttcagtttttctgtttgttctttatagatcctgcttttgatattttgactaaagaaaaaaaaaaacaagcttttaaagaatttaagttagttttatccagaagtcttactgagagctatagactgactgaggactacagcctgggaggagtctttcagaaaggttctgttggccaggagtggtggctcacgcctgtaatcccagcactttgggaggccgaggtgggcggatcacctgaggtcaggagtttgagaccagcctgaccaacatggagaaaccccatctctactaaaaatacaaatggcacatacctgtaatcccagctacttgggaggctgaggcaggagaattgctcgaacctgggaggcggaggttgcagtgagccaagatcgtgccattgcactccagcctgggcaacaagagtgaaactgtcccaaaaaacaacaacaacaacaacaacaacaacaacaacaacaacaacaaaacaaaccagaaagattctatcagactgctccaaaatagtgtttcagctcacagtttatatacaggttcagtgcatataaaatcacatcaaagtttgggtgcaagagtctatctagttatagattacagaagtgtaatcactaaccctgtcaggtgttctcttatgtgtaggaaaaggcaaggactagggccatttatcttttaaggaatacagtgactcaggcaagagctggagggtgggaggccctgttctctattctgttttgtcttcaatgcacgtttctggagagctacacgttgtcacagagtcaggggctttgggaaagtatgttgacaagcagaaatgagcaaatatgtcttcttacatttgttactttggctcacaggtatcttatctaaggaaactttgcttacgcaaagtacacaatgattttctcttatgttttcctctagaagttttatggttctaagttttatatttaggtttatgacccttttcagttaatttttgtatatggtatgaggtatgaatcagttggttttttcagtttatatttttgcttatggatatctaatagttccaccatgattttaaaattgtgacttcatatttaaaagtggagaaaatgctatactacactgtcttaatcatttattatacttttaatgtctctgacagggacaatagtaatgacccctctttcaattttattattagtcatttatatcttctcaccttttttctcgactaatctggttagagcgttagcaattgtattgatgttcttaaagaaacatcttttggatttgttttatagtttctatataattatctactattttattttttcctgcttactttgattttaattaaattatccttttctagtttttgatggtaaaagatgaggtcatttatttgagacttttcttcttttctattataggtgtttaatgctatggttttcctctttggcactggtttagtgacatcccacaaattttgatatgttttgttttcctcttcatttagttcaaaatattcaattcaaaagattttttaattacctcctttgacttctttgatttataaggtatatacagatacattacttagtttccagcatttgatgattttccagagatcattctgttattgataatttaagtgtggtcagagaacagactttttatgactcaaattcttttacatttattgagacttgttttatggcccagaatatggtctatattggtacagatttcttttgttcttgagaggaatgtgtagtctggtgttgggttgagtcttttcaaaatgtcaaattagatcaagttgactacttgtattgttcatgtctcttatatccttactgattttttctgttctgtcaattaatgactgaggcatatttatctctggctatatttgtggatttgtttatttatccagttactcgtttttacttcgtatgtttcaaaaatctgtaattagatgcatacacttttaggattgttatgtcatcttgataaagagactctatcattatgaaataacctttttttttaaaatccctgctaatatgttttgctctaaaatctactaatctactctgttagattttaatattgatacttcagctttgttttgtttagtgttagctgggtatttcgtttttttatccttttacttttaatctatttgtgtcttcatgtttaaagtatggttcatgtagggagcatatagttgtgtcttgcttttttatccagtctcataatctatgccttttaattgagttgtttagaccacttacatttaatgagtgtatatatatgtgttttcatatggttatgtttaaatctatcatcttgcttttgtctattgtcacatttgttctattttttggatttggtatactttatgatttcattttatcttcttgttggattgttagccataattctttattttatttttagtggttgattcagtgtgtgcagtaggctttaatttattgtaggcaacttttaagtgacatcgtacccctttatgtatagtacaagaacctcacaacaatacagtatacttactttactcccctgctttttaaaacttttgtaataaactctattgttattttcattatctttttagaacaactttattgaggtataatttaataccataaaagccagccatttaaaattcaatagtttttgatatattaagagttctgcagcagtggcatgtgcctgtattcccagctattcaggaggcagagacaggatcacttgagcacaggagtttaaggccagcctgggcaacagagccagtccttgtctccagatagatagatagataatgtgcaatcatcactccaatcaagctcagaaaatgtttatcattccaagagaaacctcatatttgttttcaatcactccctatttatcctcttccaaactcctgaaaaacacgaatctactttctttctcatagatttacctatcttggacatttcatgtaaacaggcttatagatttgtggccttttttgattggcttttcacttagaaaaaaatgcacaatactgcatgttgtagtatgtatctttctttctttttttgttgctgctcaataatattccattgtttaaaaataccatatttaactttatcctttcaacagttgatagacatttggattatttctactttttgatgattctgtaatgcttctatgaatattcttggagaagtttttgtgtggatatatattttcagttcttttgggcatatacttaggagtggaattgctggatcatatgaaaatgctatttaatattttgaggaactaccagattttcacagtggctgcaccttttatattcccaccagcaatgtataagggttccaatttctccacattcttaaccaacacttgttattatgtcttttaaattatagccatcctagtagttatgaagtgtgaatttggcttttgtttccctaatggctaaaggatatccagtgtcttttcatattcttgttagccatttgtctgttttcttagaaaaatatctattcagatatttaatcattttaaaattagcttgtctcttcattattgaattgcaggagttctttattctggatacaagtcccttatgatttgcaaatatttttctttctatgagttgttttcaattatatttttcagatacttatataataaaatggtttttatatttatccatgttattactattaatatttttggtatccttcatttctttatgaggatccatattttcatgtggtataattttctttctgtctgatgaacttctttttaacatttcttatggtccaacgtctgcttatgatgaattctttcaccttttgtatgtttgaaaatgtttttattttactttcacctctgaacattttttaatgtgtataaagttctagattgatagttcccccacttcccattattttaaagatgttgatcacctgtctttttgcttggattgtttctgatgagaaatctgctgtcattcttatccttgttcctctctaggtgtctttttttttctttaatccagtaactttaaagattttattgttatggttttgtaaatttgattgtgcatttttctttgtttcctgtgctcatgcttcattgagcttgttgagtctgtgggtttatagtgtttatttttagccttgttttttcactctccctttttgctttggggactccagttacgtgtacagttgacccacgaacaatgcagatccatttatatgcatatttttttccaaccaaatgcagatcagaaatatagtattcatggtatgcgaaccccacaggtatggagggccaactttatatatatatatatatatacatgtaggttccacagggctgtctgtggtgtaactgcccaatgggttctccttacctactccccaggtggaactgatttatcaagacaggagacttgcaatagcgaaagagtttaattcatgtagagccagctgaatgggtgactggagttttattactcaaatcagtctccccccaaatttggagactgaagtttttaaagaataatttcgtgagtagggggccagggagtagggagtgttattggtggcactggagatgaaattattgggagttgaaatattatataaacatatatattatataaacatatgtattatacaattgaatataatacctattatatatgcaatatattatatagaataaacataataattgaatagatatataatagttgaattgcatgtaaatgtagttttaataacaaggttgccaagtactgtattactggatgcttacattgttcctaaaattatcctatcatacatgatattgcattaagcatccttgtagcaaattctttgtcctttatatttttcccatagtataaattcctagtggtggagttacatgccttctgattcagcacactttttaggatcttgatggaaaccatgcatatacacacatttccctaatattagcattccagaaaggttacaacagtttcacctataccagaaatacatttgagcgcctattttcctactttgtatacaaacacatcagaaaaccatctttcaaggataactttcttatgttgaggcagttttaaatcacaatcattcaagcactcagtattgattttgattcattctcccaaaggtgcttgaattttaagctacttgaaaccttaaataatggaagatgtctctgttaagagaactctctgctgttgaacactgttattcagggctgaatcactttacttaccacagccacagacttctatattctgactagctatttcgacactttgtttccacccccattggtctcttttcttccctaattttcttcccttcacttcatatattcacattccttctattttaggccatttgggaattactttttttttttagaatagttaactttttaaatttttgttttatttttaatttttgtggagacagagtttcactatattgccctggctggtctcaaactcctgggctcaagcaatcctccggccttggcctctcaaagtgctggaattacaggcatgagccaccatacttggctgaaaattacttctcatgttagaaacatgcacttactcttagaatgaaatatttttcaagactcatctgtggttggaagagtctagcctgcccgaagcttggttatagaggttgtaattgtccttgttctgaaaactacggactgaaaacaccccagcttggcacagtggcgccctcagtagaaatgtatccaccctatagggtgcttctcctgtaagtggaaatcctaattcaaatttatatctgcattgctctaggtccctatgcaaatggctgagggtcatggcatgcacacacaaagaagatcaagagtttagatgactctggaaagaaacagggcagaatgaagtctgtctcttacccagagtagagttctacttttcaagaggatttttttcagtcttctttgtggaatcctcctcatttccccttaaaatgtagatctcattccttctcttcttgctctctgtcttcatgagtgatcacactcccttgagctcaattttctccaactcagaaatctgtagttccaggcctttcctgatttactacttctaagtagagattttctcccattttctaagcattgtaacacaaactagcttgaccttgaggctaaacagtttggccaatatatcctttgccttcatagtgacacttattctaagatagtaatctccataatttgaattttacaattcttggttattttggtaagtgtcaggatagcattcctctccatcaggaccacttctaaagtgaaaactatacagctgggaatacagtctttgaaattaagacagtgtttacttatataagttttggccagtttctccagcttctagaatacctgacctggcccatcatgacctgataaaatacatgtaaaaaggcgcaattgtgttaattgtgtttctctctctgcagtcagtgtgcgcaggatgggctagttgtatttcttccttggaatgcgttagctctgtgccctgtagaaaaaatgatagacttttagaccaatttgaaaataaaagatctaattgaaaagctggagaagcaaatgaaaagactgatcttatttgtggaaaaggatttatgaacatgaaatatattgtatcctgtgagtacactgaagcaagatcttagggctgacactttgaggaagagaggaaagtagccacagagagaggaaagcagcctgtagccacaggtggcgatggtattttaaaacaaaacataaggtagtcatttggtttctcaaatgcatttctgatttctttgttctgaatctgcatgtgaagcaaatgaacccatagcctccttcatcccagctgaaccatttgcttcactgtcagtgaagggggtagagtcagtggtagggataagtaacccagataaaaagtttagcatggccatgtctctgtcatcctgttttcccctttcctttttctttttgattctttaaaacggaaattctgattttatcaactttagaaatgaaacagtattgattggctcctttctcaaaaggtgaagaatgttctcctttttcttgtgattttctggagttttcatcttagcttattagttacacgtatttcaactgtatagctttttttttttcctattagttaaaactgcattcttttttttttgtcaccgttactatcacaggtattctgtgcttatctggattgacaagctgctcttgccaaaggtttcctgagcacattattttgatttgtcatatgagtagttgtattatgtgtttgaacaaatttttcagggagaaatatatcttaattataccatatgatccagcaatctcactgctaagtatatacccaaaagaaagaaaatcagcatattgaagaggtatcttcactctcatgtttattgcagcactgttcacaatagccaagatttggaagcagcctaagtgtccattaacagaaaaatggataaagaaaatgtggtacttatacacaatggagtattattcagccagaaaaggaataagatcttgtcatttgcaacaacatggatggaactggaggtcactgtgttaagtgaagtaagctagtcacagataaactttgcatgttcttatttgtaggaactaaaaaaattaattgaacatatggagacagagaatagaaggatagttacgaggggctaggaaggtgggttggttaatgggtacagaaatatagttaaatagaatgaataagatctagtatttggtagcataacagggtaaatttattgtacattttataatagttaaaagagtatagttggattattggattgtttgtaacacaaagaaaggataagtgcttgaggtgatgcgtacccatttaccatgatgtgactattacatattgcatgcctgcatcagaatatcccatataccccacaaatatatacacctactatgtacccacaaaaattaaaaataaaaatattaaaagtggcttgtttttgttattgcaggtaaacaaaggcttgattggctgtagaatttttgagtcgttccatatttctgacaaaatcttgaaatttattccttcatcttatttgttggggtgaggttaatggctgtgtccagcccatttttttcccattatgatttgatttattttccccatttgatttttttaatgggatttcttttaatttttaaagcttattaacttaaacctgttttgcacttatcatttacttcatagttttcctggaatttgtcacacttttttaaattatggtaaaatacacataacataaaatttaccctcttaaccatttaaatgtacagttcagtagtgttaagtatattcagactgttgtgcaaccaatctccagaactcttttcgtcttgtaaaactgaaaccccgtacccattacacagcaatttctcattcatccctctcccccagtccctggcaagtactactgtactttgtctctattaatttgactattagctaccttatatatgtggagtatttgtccttttttgactggcttatttcacttagcataatgtcttcagggttcatccatgtcatagcatatgccagaatatccttttgaaggctggatgataagccattgtatgtatataccaatttagtttatgtctgttcatctgttgttgaaaacttgggttgcttctacctcttggctcttgtagatagtgctgctacaaacatgggtatacaaatatctctttgaaagatcattaacagttattttggatatatacccagaggtgggattgctaaatcatatggtaatcctattttaatttttttgaggaacctctatactgttttccatagtgattgtaccatttttggtcccaccagcagtgctgggttccagtttgttcacatccttgctaatacttcttttctttttttgataatggctatcttaatgggtgtcagatgttatcttactattttgatttgcatttgcattttactgatgattagtgatgttgagcatctcttcatgtttggccgtgtgtgtgtgtgtgtgtgtgtgtgtgtgtgtgtgtatgtgtatatacatttttgtagaagtgtctactcaagtcttttgcccaatttttaagttgtttgttggtttgttgtttttgattttgagttgtaggagttaggaaagtttacttttattgctaagtaacttctgttccacttatttttgtcaagtatgccgattatgttgaatctttatgtcctgcgatttatatccataatttctttttaaatttttttatttttattttttattattatactttaagttctggggtacatgtgcacaacatgcaggtttgttacataagtatacatgtgccatgttggtttgctgcatccatcaactcgtcatttacattaggtatttctcctaatgctatccctcccctagtccatcaccccctgacaggccccagtgtgtgatgttcccctccctgtgtccatgtgttcttattgttcaactcccacttatgagtgagaatatgtggtgtttggttttctcttcttgtgttactttgctgagaatgatggtttccagtttcatccatgtccctgaaaaggacataaactcatccatttttatggctgcatagtattccatggtgtatatgtaccacattttctttattcagtctatcatttgatgtgcatttgggttggttccaagtctttgctattgtgaacaatgctgcagtaaacatatgtgtgtatgtgtctttatagtagaatgatttataatcttttaggtgtatacccagtaatgggatggctgagtcaaatggtatttctagttctagatccttgaggagttgccacactgtgttccacaatggttgaactaatttacactcctaccaacactgtaaaagcattcctattttccccacatcctctccagcatctgttgattcctgactttttaatgctcgccattctaaatgatgtgagatggtatctcattgtggttttgatttgcatttctgtaacgagcagtgatgatgaacattttttcataagtttgttggctgcataaatgtcttcttttgagaagtgtctgttcatatcctttgcctactttttgatgaggttgttttcttcttgtaaatttgtttatttgtagattctgtatgtccataatttctaattaatctagtaaattccattattgtaagcacatgtactttttcccaagccagacttccatggcaccaacttggttttctgcagtggcacttctgtcttttgtagttttaaatttttagtttctgcagtgatttttttttatttccttaaaaaattttaaaatcaaacttgtaaatgtttataatttaaaaatgtataggtagatactttatttggcaaacaatgttagctatcacttttaccatgttcactatattgttcacagtatgataagtattactccaggtgtcttaggtacattaatcaattcaattcttatagtcatatgtggcagccttactattattatacccattttacagaggagaaatctgaggcaaggagacatgacataacctgcccaaggtcatactggcaggacaaggatttgaacctaggcagttggattccctagcgtactgtacttgtaactactatgcagcactgcctctcttcctccttttcttaaaaaaagaaatgtatgtgctttatttgaattctgactcaaccaaccaaactgttaaaagttataagaaaatcaggggattgtgaacttaccgaatatttgatgatatcaagtacctctgattaattttttaactgtgatgatggtaaggtagtttccttataaaagagttcttttaaggacaaaacagctaaatatgtaaacataaagttacttacagcatatgtattatgctgagttatttacagaagaaattaaatgatgcttgggatttgttcctctatattatctttaaatatattcattttaattgatatacatttgtacatatttatgggatacagtgtgatattttgatacatgtatatacaatgtgtaatgatcaaattaaggcaattaacatatccatcacctcaaaccttcatcatttctttatacgggtaacagtcaaagtcctctcttctagctatttgaaaaaatacaataaattgttgtttgctataagtcactcttcagatctatagaacactagaacttatttttgctatctaggtataactttgtacatccattaaccaaactctccctatccctccctgtcccctaggcttcctggtatctagtaagcactatcctactctctacttctgtgggatcaacttttttagctcccacataggagcgagaacattgcagtatttatctttctgtgcctgacttacttcgcttaacatgcagtcctccaggctcacccgtgttgctgcaaatgacaggatgtatgtaatttaaagtgtcaaatagctctgaggcttgccaggaaagaggagtccttgcttgcttcctacaattttaccttccccagagctaccactttcagttgttttggcagcctcatttgatatttgcatttaatctgtaagattttttttaacttctttttgaaaatttttaaaattgtgaatgatatgttttgaaatatgtgctatgtggaattctaaggtttttatttctttttatcttactagtttggaatatttatagatgtaccatgtgcaaagtgtaccattcacatactcccatcctgaacctccttttcttagtatagttaggtcatgattttgactaggccattattcagtgttaataggatgatgaccttgttaatgctgttcatacctgagccatgtagaattctatgaatccttttcctcttctgcaaattttttgttctatttaaactaattgttcttttgatgtttgcttagttttctatgtgctttttactcattcagtcctaaatgctcttggttatccaaatctcctcttgatatactacttcttgagtctttttgcttatcacccaaggatttcccttcacaattatgccaggaattcctttttttctccctcttgtattggactcctgtttcctgtatcacatgcctgtctttttcttagtttcctccctgttttgcagaagaacatctgccaatagaattctaggttgtcaactgccttcctcattgcttcattgtcttctagctttcagggttgctgttgaaaagtccagagactttctgattcctaatcttttgcttatgagcttccctacctgctttttgatattttataggacctttttaatatccttacagttaaaaaaacacaactcatgatgacagatgctgtgtttaatgtgggcatattgaaatcaaatgaaatgggcaggtaggcactcagtgggcccttacagtctacacagttatgaccttacgttttaggaaatattttgagttagtcatttgacttcactccaccccatttcctttactcttttattctggaattctatttggctattagacctgctggactcattttgtagccttctcatttttactgttctagtcttctttacttttttttttttaactctacattttgggcacattccttaaagttatattccaatctgtctactgaattttttttgaattcttaaaaattgacatataaaattataagtatttatcatgcacaatatgatgttttgagtatatatatattgtggaatggttaagtctagctaattaacaaatgcattacctcacatagccaccatttgtttgcggtaagaacagttaacatccactcccttggcattttccaagaataccatgtatcatcattatctatagtcactgtcctacacgatggatctgaccttattcctcctaactgcaatagatctcctgtctaactgtaaatatgtatcctttgatcaacatcttcccaactccctctccccacaaccaccccagcctttggtaaccaccactttgctctctacttctgtgggaaaaacttttttagattttgaattaccactttttaagcatcctgtttttgtttgaataagtgcaatatattcttctcgatgttactattgttaaacctattcatctgctcagattccagagagaaaaatctttccgtctcaggccttagatgatgtaagactggcttcagatgctatttagctctgataggcggaagagataataagaaagaagacaagcttcagctctgaactgcctgtatctcatcttgttcctccaggtttgggcttcaggaatttcttctattttgtttatatcagactatagggctctctgaagaatgatacatagtttgaaaaatttccccattttatctaaattgttgtatatctgtaatagttttctaaagtttttagaataaatttgtcctttccaggtttcagcattgatggtttcttctttcctcctttattgcttttcattcatctattctgttttggagacgaaggctttaaaatctttacccacgtagcttcccccagctacctctgagaagtctgttttatcttttgcatcactaattttattttttgctttttaaaaatattctactttctgcttcattggttgcttttattcaagttcataattcagattttcttttctggttagcgcagactcttttctggtctcatatttctttctatggctacctgctctatgtgcaaagattctactatgtcccctggaattttaagaacatgagctagaaattttctgttaatagagttttctcttttatatagtatatctatttcttaagtaaatatttgctctgattctagaatcttccccttttctgaaccacaatgtgttctatttgcctggtggatttagatttttctcctttgcttatccttagggaagtcaatgcatattcagtattgggtattgccttgttttctttccttctttccttctttccttccttccttccttccttccttccttccttccttccttccttccttccttccttccttccctccttccttccctccctccctcccgccctccctccctccttccttccttccttccttctttccttctgttttaaaattttactttaagttccgggatacatgtgcagaacatgcagtttcttacataggtatacatgtgccatggtggtttgatgcacctatcaactcgtcatctaggttttaagccccgcgtgcattagtaaccctgtgttctttcaagaaacttgtatgagtcactatttgactcaagtccagacaaaggaaaaaggttacatttgtagtagattaatttaccaattatgaattcatattcctgtgaggcctgggaaaagagccagcatcagctccagaagtaatcaaagggaagtttgcctcaaaccaaagactttgttttaggtatttggtgtggcactcagtaattagcaaggtcattgtcacttggcatggctgcccttgccaggagccagctgggagtgtctttttcccatgtgttttctgtggtagtcatcatggccacctgtcaaccagaagtaaatgcagccagaggttacttgcttggctggcctctgaagccaggagcccttttaaaggagttagtgtgttttaaatgtaccccaagtcttcctgggcttagttccctcagcccccatcgctctaaactaggggtatcattatgggtttagtggattctcatttgcttattttctggttgtgcagttgcagtttcacatgaagaggatatcgtgttttagtccttttgtcaacctcccatgttgattctttcaagtatatatttctgaacgtttaagatctatttatagtttccagggctgattcaggatattcctctgttataatcaactggtcatttctttggtaatctggcacaaagaaataagcttatagctttcttatttggaaattgtattttatatatgtgatttgaatcataggggggatattgaggtaatttagacccagtgattgtaaaggaatggatgaatgatccaataaataaatagatgacaaagctcatcttttgcaggtgagaggcattagaagtaattttacggttttgagaagagaaatatagatgagaagagatgcctaggagaatagaaaatggagacaactaggaaagaagagaagaggcagcagtaatgctccaagggcagttggagagcctgatgtcagctgggcaaacccacattgcttcatggttttctgtggctagaacacagttttgaagctcaagcaaaggaaatggagagttaggttggtggcaggttggaagagttgcagaacaggtatccaagtacttggaagagttcagaggggtgtatttcttagtctcactctgttgcccaggctggagtgcagtggtgcaatctcggctcactgcaacttctgcctcccaggttcaagcagctctctgcctcagcctcctgagtagctgggattacaggcgcctgccgccacgcctggctaaatttttttttttttttttttgtatttttagtagacacggggtttcaccatcttggccaggctggtcttgaactcctgacctcatgatccacccacatcggcgtctcaaaatgctaggattacagacgtgaaccaccacacccagccagggatgtatttctttaaaaattattgtgcaactctctagttgacagtctggggctctggtaaggcgggggttcatctgtcaaagtgagccagcttactcagctagatactgtatggcatgattacttagggtaatgtcttttttgtcttgtttagttcccccatgatttgtgcagttttgtaaataagttgagaagtaaatagatttcatgatataattttaagacttcactcccaagggaaaactgatttatacctttgaagttatgtcatttagcccttgtatttggcaaagtaagcatacactattttataaagcgttcttgtaatgtgtgaataggttcaacaaaattagacgtgtcgcatgttttaggagaaggcagttaattttctgtcttattttcttcttgaaaatgtgaaactaacaatctgtcatgtttattaggcatctcaaggaaatgaaacatccaaatgagggttaaatggttaaaattttatatagatgagaagagcacaaggttctctgtctcagggttactctgcaggtcatctgactttcatcctactttctccattttttatctgacatttttgcttaaagattccatgtgctttccatctctttttaatctttgatcacatggaatattggcctatggaaagagtatgaatcttagcataggccctggttcagacctcagctctttcatttcctgactgtgtgactgtgggtatgttgcataacctcacaatacctttcaaagcctcagatgtctcctctgtaaaataactgaatagtatctgcctcaaactgttggggaaatgactgctccaaagctcagcatccagtggcctttcatgaaatcccagtctcgcatctttccctctgctgttgttagtaataacgtcatatgacatatttgtttggtggatctcatccatttctatttcgctttccttactctaagctaggtgcctctatttaccttttaggcaactctctatattctgaatattgaaaatattttaaggttatattgcttaatgacatagcttggtgaaatgatattggacctgagcatatagtatgcgtccttaagaatggaatcttatgtgcttgattttttgctttttagttgtattattgatatattcatttatgtcacatagagcaagataatgtgaattataaatacataagagggagaaaggaaaaatgaaagtaggagtgggcaaaaaataatgccaggaataataaatacatgagaaggagaaaggaaaaatgaaagtaggagtgagcaaaaaatagtgccaggaataagttcagtgtaaaacagtgcaccttggggttcctgtaattttcttgggtaggtttggcactctagcagtcatcttgaaaaaagaaaggtcctgtatacatatgcttttctcctgggttgtttatttactttcacagtgtgataaacaagtctcatttgttcctaaaactgggactaaggagaatatcagtactgtcacagggcagctgtggaattcggtgttgaatgtcatgacaagataacttgagaactttactacttatttgtgaatgaaaataattgctgtaatgggagaagaaaataggaaggctctacagttctaagcagccagaacctaaagtgattgaaactgtagtatcaaggatgctgcacaaaaatgtagcaattaaaaatttaagcttatagaagttgctgtcaaacctagattatttcttagaaaagcagcacttctgagctcctcatttgcccagtatccctgagctaatatagggtagcaccaagggatgtgggggacaaaggacttggattaaatgtccaactccacagttcctgctgtgcaagacttggatcttgtgacatctggttcattacttttactattatgaaaagtatcatttcccaatagtttaaaaagtgttcaggtatcatcttgcatgttggtgaaactaggaagtatatttacagacaaaagctccttaaaggcaaggttggcttagccttactttttttttttgagacggagtcttgctctgttgcccaggctggagtgcagtggcacgatctcggctcactgcaacctccgcctcctgggttctagtgattctcctgcctcagcctcctgagtaggtgtgtgccaccacgcccagctaatttttatattttaagtagagatggggtttcaccatgttggtcaggctggtctcaaattcctgacctctaatgatctgcccccactggcctcccaaagttttgagattacaggcctgagctgctgtgcccagccaataacgtcttttgaataaaagaaaagatattgttagggagtatgaacatcaccagaaaatgaaaatgtttcttaaaaataaacgaatttttaaaaattattttcttaaaatgaaaaatttttttcttctggactaaattgcaatgtggaaagagtcacatcagcctttggacagaactagggctgtgatttactacagggaagttagcatctttctgagttttcttaatgaacacgtgaataagagatttggttatactttgtgcttatttagcatcctctctttgaggatgtcaaaaggattttagaaatgttctctttctcacacaggtggacgtctgatttatgaagctccccatccacctatctgagtacctgacttctcaggactgacacctacagcatcaggtatcttgcctttctttagtcttaaaagcggtaactaagttccttgaggagatataggcagggaacacattaacttcgttacgtttcatataggcctgggaaccggagttgctgctgtagtcctggttctaccattaaatgtgtgactctagtcccttttcttctctaagcctcaattttttcttctgcaaataggtggggttggacggggtgctatctaatcacttgacggtattatggtagtctacttttatccgaagcttcactttccacagtttcagttacctgcagtcaaacttggtccaaaaatattaaatgaaaaatttcagaaacaaacaattcacaagttgtaaattgcacaccgttctgaatagtgtgggtgaaatctcatactgtccatgtgatttgtccctttgtcctgcgattccacactgtgtgtgctacctgtacattagtcactcagtagctgtctctgttatatacagggttgggtactattcacagtttctttttctttttctttttcttttttttgagaaggagtctctctgtgtcgcccaggctggagtgcagtggtgccatcttggatcactgcaacctctacctcccaggttcaaacaattctcctgcctcagcctcctgagtagctaggattacaggcatgttctaccacgcctggctaatttttgtatttttagtagagatggggttttgccatgttggccaggctggtctcaaactcctgacctcaggtaatccttccccctcggcttcccaaagagctgagattataggcgtgagccactgcacctgacccactatccagtttcaagtatccactggggggcttagaatccactcctcagataagtgggggtggttactgcattctctttgccctctatgtaagccgtcagctctccactgtggattattcaattcctttattatttaatggcaggatggcttttcccccgactcaccctcctcagctctgcaacttgaaactgtcttcccaaaacatctagctgggatgttggattcaaacctatgaaaattcctcaacttaagagtatttggacagatagcacagaagtcgtggcttttagaccttagcttttccctaccggctttctgtttgcattaagctagtatttgacacttgatgtctagggattcttacctcctttggccaatggtacttcacacccatatgctagtccttttatgctaaatgtgggttttcctgttgttttccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccaggtaagggcttcaaactagcagaggtctgaggtaatcgtaagtttgtcaaatatttaaactgggtttcaggaagtgtatttgactctagggatcatgtatatctctctcgctatcatttggtgtgtattcgaataatggtgcttttgtgagtgaggtgccatttcgttcaggaagcagctggaacaatgaacaagtgattttagtgaactggcctctgttcataggaggccttggttttcagtgcttaggatgtctgacattataggcatcaaactctaaatcaaagtaagtcagtagtaaaccctgctgcttttcctctcttggcttttttgtgggccggggggtggggtggggtttaatgaaatatatcagaatggatctaattttataacaagttttctgagggctgtcttgttgtcctcctcctatacttactcttttgccttgatctgttctaggaactttgaaacaaaatgcaattccagaaacttctgagcagcaatcgtatgagttatttttttctgtccagtgaagagcagtaatacggcagggacatggtctttgttcagatgattttacagcctgatttaatcaggcattggctggactctttcagattcaccaggcagcagggtacaatgtggaaacagactttggagtcataaggccacagttcacatccctgctcctctgattgcaggataaagagccctagtcatgctagcttctctcagcttcagtttcctctcatgtaatcattcctcacatgatggttatatggataaaatgatggttcatatacatgaggcatacagaggtgctcagcaagtgtagtttcccatttactcttcatttatcttctttctatagtgtgacctcctttcttatttgtgacaatcattttttggccaactttatttttatttatttatttttttgagagagagccttgctctgttgcccaggctggagtgtagtggcatgatcttggttcactgcaatctccacctcctgggttcaagcgattctcctgtctcagcttcctgagtagctgagattacaggcgcccgccaccacgcccagctaatttttgtattttagtagagatggggtttcaccatgttggtcaggctggtcttgaactcttgacctcaaatgatccacctgccttggcctcccaaagtgctgggattacaagcctgagccactgtgcccggcctcgggcaactttgaagaaaaaagcatactttcaagaaagagccatactgattgaaatttgaacttgatacagaacgttgttccacactgtttttttcagtatgattttgcaggctattcaattttgtatgtattttaagtaggggtttgtgtgtttgtgagagaaggagagaaggaggagagggaaaaaggagaacaaggggcatttttccctcatatagtatagtgttttctcctcaacaccatttgggatgtcatcattgttatcaaccttgggattttatcatatgaataaagccctttattcatatcatatgaataaagaataaagtactaaggcctttagtattattttccagaatgtttagtgttaccatcgtcatacgcattcctctttctggtaagtggaccattgtcctttcaacacttcatttactttgggtgtttggtttcccttatcttcaatagacttttttggtgtctgagagacttggagaatgggcaaagagatttagtgcctgttacctgaggtcaccatttcaaagtccactgcagctgttcccatgtaatgactcttcttagtcctttcgtgaagtgagttaggctagtgcgggttttctagacagggcatttccacatcccggtttgctgctgtcatctttcagcatttccaacagcatcttcttatctatatatcttctctgttacacaagctcctatcagctggtgaggaatagaaatacctctaaatgactcatttaattaaaatgtttaacactgcccaaaggagaaagaggttctatttcatacaatcactgggggaaatgtgtactctcgtaaattctctgtgggaaagtaaattggtacagtcactctggagggtaattcaacagtatctattaaaattatacacttctgcacatgccctgctcctgtcttggaatctacattagaaaaccactcacacatgagcccaaggagtgtataaggaatgtataaagatattcattgaagcattggttgcaaaccaagaagtacaaaattttgtgaatatccaatagtagaaagacttaatgaattcaggaatgtggacatgattgaaatactattcagtcattttatttatttcttttttttttttctgagacagagtctcattctattgcccaggctggagtgtagtggcacgatcttgtctcactgcaacctccaccttctgggttccagcaattctcctgcctcagcctcccaagtagctaggattataggtgtgtgcctccatgcctggttaatttctgtatttttagtagagacggggtttcaccatgttgtccaggctggtctcaaactcctgacctcaggtgatctgcccatcttggcctcccaaagttctgggattacagccatgagccactgcgcccgaccactattcagtagttttaaaatgaggatgtctacacagctatatattactccaagatatcgtatggaggaaaaagaaagcaagacgcaaaatagtacttatgggaagataccattaaaattctaaaacaagactgtgtatttttagggagaagtatatggtacattaatggaaatggataatgaaagtcctagaacatacattcttaacatagttatattgccccaagaggacaaaaattgggttttgggagatgaaaaaaatccctccagagcttatacctctatccaacaaaatcttattccttagtatttagttttttctcattagaaaaaatttaaatgtaattaatttttctccttaaggatcactaatgagaaaaaaatatggccaagaaacactggtttcttgagggaggcacataggctcaccagtcaccctgcttcaatttactaattacctgagcctgaggggaaggtatccaccctcttagtgcctctatttccttacccacggaatgagcatagcattaatgaagccaacctgatagggttattttaaggcggaaatgaaataatttctataaagctcagaatagtgcctggcacatattctgggcacatattgcccagtgcatattagcaagcattgttattattgctcagcaagccttgtggcagggctgggggatacaagaataaataagagaaataagttttgccctgccagagtttacagatatagtgggagatacacagataaaacaaaaagttacaacgctttgtcacccatgcaggaatgcacaaatacaggaagtatgggtgctctgggaggaaagtggagacccaagaaaagatttagaggatcagggaaggcttcttgaaggaagaccactaggctgaggacaaattaatatgagttattttggtaaaggagaagaaaaagcataggtgaatgtcaagtgtcccaaggtatgtgtgtgtgtgagagagagagagagagagggagcaaagcatttagaattttgttttggatggttgcactacagtggggcatgagattgtaaacagtgatgtccctagagccacctataccaactcacagaagcagattgttaaattttcaggaatttcgcgagccaattgacttcatgccagcagcttgaaatcagccacatggaatagttatactgcagaaatcggcaagtgctagaattagcataaatgggttaggttataaagttggagattttacagggtctttcaaaccgtattaatgaatttaacattgatcttaaaagaagtctttgttagcttaatggtcccagcctttgaaatagacctgggttcaagttctgactttcgataatagttttattgagcaagtttattaattaaccttaaccagggtagttgcattattctcaccgtattttgggaatagtggcagcctctgatggttggggaactaagcccacggggaaggagtcagctatacactgggacattaggtcatagagatagatagcttcttctggagagatgcagaccattgggtcacttggttcccaggatcctttggccaatgatgggcctcctaattatatgtcaattcctcacatgtaatttgtacagtgaaatttagtccaaggctgacttgcccttgccccgaagcttctactgatgtcttctctcttattatcagttttgcccaagttcaaagaaggtaaaaataatttagatatagcatcttcttaggcaagcataataagcagctcactcagtcaccttagcctggtattgtctggcacatcaacttgctttcttttccagtgaattcagggaccttgtaaagataaatccacattcaagtgtgaaaggcctgaaaatccttttctaaggccaaaacaacaattttttagaaaaacttttggttttgtttgttactctattcattgggtaacaaagagcatttttctaatcaaggctgcctaatactacatataaacgaattaatatgaacaaatagcttgtgattgtttcaaacaataatagggaagaaagcttgcattgtcacgcctgctgggattgctgtttagttagttgaaagatatgccttgttttttgaagtggggcaagtttgtattctctgctttacccctgccttgactctgagacagatttttgttttctcatgctgagagagcacctagctcttacaaagctaggtgatgaatactaagacgaaactggactagcagcagcaagaagatgccgtgtttgtaaccgatttataattctgctggtccagacactgaaaaagagttttcttatccaaaggaaactcctgggatgtatttgcagacaggaacctgttcatcattaggttgagttaatgtgttcgtatcctgtggatattgggggcatggggatggggtaggaaaccaaacaaacttgcagctctccagagccattttctgtttctagcactgtgttaagcattaccctgtgcttgatcaggttactgtggatagaagttggattaaaagtttcattttcattgttcatgaaagagtcaatagttcagtaccagagtgagcagtttggcttctcttaaacctaggattatattagaggccagaataggtatctgaaaacctaaaagatattcaggtctcacacctgtgattccagtaaggcaagagtcttctttatcagtatttttcatggtgtatcattctgtctctcatttgttacatgaccattttgttattttttaattttcatttttatatttatttgaatttaaattattttattctaaaatattttactttaagttctgggatacatgtgcagaacatgcaggtttgttacataggtatacatgtgccatggtagtttgctgtacctatcaacccatcatctaggttggttttttttttttttttcttgagatggagtctcactctgttgcccaggctggagtgcaatgtcgtgatcttggctcgccacaacctctgcctcctgagttcaagcgattctcctgcctcagcctcctgagtagctgggactacaggcgtgtgccaccatgcctggctaatttttatatttttagtagagatggggtttcactatgttggccaggctggtcttgaactcctgacttagtgatccgcccaccttggcctgccaaagtgctgagattacaggtgtgagccagcatgcccggcccatcatctaggttttaagcccgcatacaataggtatttgttctaatgctctccctccccttttcccccactcccagacaggccctggtgtgtgatgttcccctccctgtgtccatgtgttctcattgttcatctcccacttatgagtgagaatatgtggtacttggttttctgttcctgtgttagtttgctgagaatgatggttttcagcttcatccatgtctctacaaaagatgtgaacttattcttttttatggctgcatagtattccatggtgtatatgtgccatatcttctttatccagtctgtcattgatgggcatctgggttggttccaagtctttgctattgtaaatatagtgctacaataaacatgcgtgtgcatgtgtcttcatagtagaaatgatttataatccttcgggtatatacccagtaatgggattgctgggtcagatggtatttctggttctacatccttgaggaatcaccacactgtcttccacaaaggttgaactagttcacattcccaccaacagtgtaaaggtgttcccatttctccacatcctcttcagcatctgttgtttcctgactttttaataatcatcattctaactggtgtgagatggtatctcattgtggttttgatttgcatttctctaatgaccaggaataatgagctttttttcatatgtttgttggacacataaatgtcttcttttgagaagtatccgttcatatccttcacccacattttgatggggttgttttttctcttaaatttgtttaagttccttgtagattctggatattagacctttgtcagatggatagattgcaaaatttttctcccattctgtaggttgcctgttcacaaccattttggttttaagtcaagaacataaagatattttgatccctccaagtgatttcctgtagctttcattgaagatgtgaatttgggtagattttcaatatcttagttaagagattgttcctccaattctcattcagtgttctgataaaaagtgattgcggctgggtgctgtggctcacacctataatcccagcactttgggaggttgagactggtggatcacctgtcagaagtttgagaccagcctggccaatatggtgaaaccccgtctctactgaaaatacaaaaatcagctgggtgtggtggcgtgcacctgtaatctcagctactcaggaggctgagacaggagaattgcttgaacccaggaggcaaatgtggcaggttgcagtgagccgagatcgcactactgcactccagcctaggtgaaacagtgagactctgtctcaaaaaaaaaaaaaaaaaaaaaaaaaaaagtgattggtgtctgtttgttgtcttttggaagacacttttttttggacatccttaccaataggtactctcaacaaaatatgtattttcaaaatctgtgttttaggttttatttctgttattagaaagtggattttttttttatcaaagcaactgaatttcacattaaatgggttttttttttgaggctgaaagattcgtctttttggatagaactttgtactatggcagttttcagacattcacaaaaataaaaataacaatctcaatatagccaacacctagattcagtaataacattttgacacagttgcttcacttgctccttttttgggggatgaagtattttaggatccctagcattgtcatcttttaaaaaatccccttatgttaatatgcatatctaaaaaataatttgcttaaataaccacactgccatcatcacacttagcaaaagtataaataactccttaatatcacttgatactcaattcacattcaggtttcttcagttgcttttctaaaatgtgttcttgtagttggtgggttatttatttttattttttaaaaacattgattagatcagtttactcttctgcataaaatgattcaatgactcttaaggtttaaaaaggcaattccacttcctctctttattttctaagtgagaaaacagattgaaattataactagaatatttcacaactgaagaatacaaaaatgagacacacagaaggcttcagagtaagggaattcatacaatgtttgcaattattaaattatgagtctctgaaataagggattacagattatcttgacagtgctttctttcaaactaaaatgtgaacaattaattgcagtatgaagtatgtttccagtgccacacgataatttcgtctaacatagaattgagaaaaggtaatgcatgggcgtagacccgggtggattttggttcaaatctagactgttatacaccatagctgggggatcttcagtacataggtctttttcagctttattttttaaaatctctagaattcaaataacatacagtgtggtaacaagtttaaatggcaaaaataactgttaagtgctttgtatagtatcagccttttgatagatacctgacgtatgttagttctttcccttttccccatgattagtctggaagttcttttttttttaaattttattattattacactttaagttttagggtacatgtgcacaatgtgcaggtttgttacatatgtatacatgtgccatgttggtgttctgcacccattaactcgtcatttaacattaggtaaattctggaagttctttacagggagaaagaggtaaccactacatatggtctgtgtatgtggtatgccagaagacccatcaaaggaaggccacgttggataaacactctatggaaaactccaacgtattgccaggaataaatgcatgtggagataaacattgagacttctgacttcatcttgaaccatgtttctattagaagttaaatttgttcccatattgcaatttaaattcatcttgtgcctccttttgtgtttataaactcagataaggtttgagaagagatattattttggaatctgaaagcccattttgaattttctattcataagatgaaattgtacaggggtacctagggtaaaccacataagacacctttcatgtttgtttatttttctttctaatacatcctttttaattggtttagtcttcaatggttaatggagctactcctttatctttcaaagtgggtctggctttttcccacttcttgcccattagggaactgtttgcccaatctcgttttcatacccctagattctccagctgtctttctttgaacttttgttgcagctttgctgtgaatacacactaaggtgggacagtggcctgctgtttttttccacctgagaaaatcatagagtccaggggatttctgtcttttaagatctgtaccttgccttaataagactgtcatttaaaaaaaatcaacctttccctgctgtgtgaaaatattaatactgccatttggtaattgcataacatcacttaagagctgcccttaagttaaacttatcccatttcatacatgattgtgttaggcaggctcaggccaggagaaaagcaaaagtgggttgatactttcttctcagcatcagagaatatgtttattagagggccatggagcatattagtttctgaaagcatagattagaaataaagcaactttcaatgattcagacaacctttagtagcaggaattccaatcttgaaggaagaagagtagggtgtgtgtgttggtcaactagttggctgatttcaaagtcagaatgtccagcaggtgatatcaaacatttgcacttagatgagtttccaccaccaagcataggaaggttttggagtggagcaggtgtaggccccagctctcagggctttgcctacttagaactctgtttagtattaccttaattgtggttgatcaggttactgcagtaacctggtaaagacagtggaggagaagacccaggaagcatcccagctcaatggcacaggtcatagtgcagggctcacctctgacatgctggattgtgtagagatgactgatgggaacttaggaatgagctgtcatggtcagatgtagatcccacttatgtaagataggtcaagatggagagacttaaccatagatcattccactgtctcattcaaaactagctggaaaactagggcaacactgaagttacaggggggaattcaatgctatggcagtggaggaagaaaaggcaggagaaacaaggtggcaaatgattgtgaggattatagtcatcagttacaccatggtatttactctttcaaatgatgtatcacaaatatacatgatatggtttgactgtgttcccacccaaatcttatcctgaatcgtagctcccataatcctcatgttgtgggagggacctggtgggaggtaattgaatcacgggggtgggtttttcccatgctgttctcatgatagtaaataagtctcatgagatctgatggttttataaagggcagttcccctgtacacactctcttgcctgcggccatgtacgatgtgcctttgctcctccttcaccttctgccatgattgtgatgcctccccagacatgtggaactgtgagtccattaaacctctttttctttctttctttttttttttttttttttttttgagatagtctcgctctgtcacccaggctgaagtgcagtggcatgatcacagttcactgcaacctctgcctcccggtttcaagcgattctcctgtctcagcctcccaagtagctgggactacaagtgtgtgccactacacctggctaatttttatatttttagtaggatgggatttcaccatgttggccaggctggtcttgaactcctgacctcaggtgatccacccgtctcggcctcccaaagtgctgggattacaggtgtgagccaccgtgcctggccctaaacctcttttttttttaataagttacccagtgttgggtatttcttcatagcagtatgaaaatggactaatacatttactcataggagtcttaggaccacatttggctttttttttttttccccttaaaatggttataaatgaattgctctcagtatctaaaatattaagtgctgctttttaaaaattgtataagtttattgctgtctcttagctcatcacagtaaaaacatagtttatagagataagctgttttgtaataaaaaaaggacaataatggaaggtagtagaagataataaaaactaaaatagatacaaaattccattttaaaaattgaaatggaacaagtttataaggaaatatattgttattagcctttcagcaaaatggcctaatggaaaataatttttcatttttgtcagtatgaattattacattgttttgacctgtcagttcaagtaaggctgcattttagagctggcatttggtttatgaagtttcaagtcttctgggttacctgattaaaagttgcaggagaatagatgtcacagaaatagagttctcagtgttcaacatataaaaggtgatctttttctctttgttttgtggatgagtaaattaacattccctcccatttcttcctctctctcttaatggctcagactgaattcaatttctttctttccttttttaaaaaaaattaagcaaaatgaaatgcttacagggagttataatgcaataacatagccattacccagctttgtaaaatgttaacatttcgatgtaatttcttcaagatcttttgggacttaatacataaaacaagtcagtaattacagataaagttggagcccttttactccttcctaattccattagcctcctctttgcccagaccattaattgatacttatcgtctctctgcatgtgcttgtgaatgtatacatatgtgagaaaaacataaaaaatatatagtaggcttctgcaggtttatttattgatacataatatttgtacatgtttacagggtacatgtgatattttattacacacatagaatgtgtcatgatcaagtcaggctattcaggctattcatcacctcatgtacttattatttctgttgagatatgttgggaacacatccatgtgttcctatccatatcaatgtgttgggaatgttttaagttctctcttcttgctgtttggaaatataccatacattttcgttaactatagccaccctactctgctatcgaatgttagaacttactccttctatctaactgtatgtttgtacccattaactaacccctctttatcctcacctccccattacccttcccagcctctggtaaccaccattctattcactatacatgagatcaattttttttaatcctatgttcatagatcccatgcctgggatatttgtcattctgtgtctggcttatttcgcttaatataaggactgccccccactccattcgtgttgctgcaactgacatgatttcattcttttttatgaccagatagtatcccattgtgtatatataccacattttctttatccattcattaattggtaggcatttaggttgaatctgtgtctctgctattttaaatagtgctgtggtaacacatgaatgcaggtatccttttgatatactgatatctttttcctcttctacttttttttgtttatttttttgtttgttttttgagacaggttctcactctgtcacccaggctggagtgcagtgttgtgatctcagctcactgcaacctccaccacccaggctcaagtgatcctcccacctcagcctcccaagtagctaggaccacaggtgtgtaccaccatgcctggctaatttttttttatttttggtagagacggggtttcaccgtgttgcccaggctggtcttgaactcctaagctcaagcaatttgcctgcctcagccccctaaagtgctgaaatgatgccctccctcccttcctcccttcttcctttcttcctttcctcctttcctcctttcctcccttcctcccttccttccatccttaccttctctgtctttctttcttttttctcttttctgataaatagccagtagagggatacctagatcatatggaatgtctggttttagtggtttttttttttttttgtagagacatcttcatactgtttttttttaatagtcactgtactaatttacattcccaccaacactgtataagagttcccttttctctgcatccttgccagcattttttttttttgtctttttaataatagccattctggctggggtaagatgatatcttattgtggttttgatttgcatttccctgatgattaggaaagttaagcgttttttttcatatacctactgggcatttgtatgtcttcttatgagaaagtgtattcatatcctttgcccactttttaatgagattatttgcttttttttttttttaactcttgacttgtttgagttccttccttgtatactctggatattataccttgtcagatgaatagttagaaaatattttatcccattcaaccagttgcctctcattctattgattgttttaaaacatttagtttaaaatagtcccttttgcctgtttttgtttttatttgtgcttttgaggtcttagccataaaatatttgcctagatcagtgccccgaagtgtttcccaatgtttttagtaattttatagtttgcagtcttaataaagtctttatcttgagttgatttttatatgtggtgagacataggggtccagttctattcttctgcataaggatatccagttttcccagcaccacttattgaagagggtttctttcctcagtgtaggttcttgatgcttttgtcaaaaagtaggttggctgtaaatacagggatttatttctgtgttttctattctgttccattggtctatgtgtctgtttttataccaataccatgctgttttggttaccatagctttgtgatatattttgaagtcagatagtgtgatgtttccagctttgttctttttgctcaggattgctttagctatttaggcttgtttttggttctgtatgaattttgggattgttttttctatttctgtgaaaaatgacattggtattttgatagagattgcattgaatctgtagattgctttgggtagtgtgatcattttaacaacgttaattcgttcgatctataagcataggatgtctttccatttgtgtcctcttcagtttctttcatcagtgttttgtagttttccttgaagaggtcttttccctccttgcataaatttggtcctaggtattttattttatttttgtagctttggaaaggggattgccttctttatttcttttttggatagttcattattggtgtgtaaaaacactattgatttttgtatgttgattttgtatcctgcaactttactgaatttatccaacgtaggagatttttggtggagtctttagatttttctagatataagatcatgtcatctgcaaaggggggcaatttgccttcctcttttccaatttggatgcctttatttctttctcttgcctgattgctttggctggaacttctagtattatgttgactaggagtggtgaaagtgggcatgctgtgttgttccagttcttagaagaaaggctttcagcttttccctattcaatatgatgttagctgtggatttgtcatatataggctttattaggttaaggtatgttccttttatgcctagtttgctgagagtttttgtcatgaaagaatgttgaattttatcaattttttttgcatctattgagatggtcatatggtatttattcttcgttctgttaatatgatgtattgtgtttattgatttgcatatgttgaaccatcattgcatccatgggataaatcctacttgatcatggtgcatggtgcatggtgcattattattattattattatttttttttttttgagacagagtatcactctatcacctaggttggagtgcaatggcataatcatagctcctgggctcaagggttcctcttgcctcagcctcccatgtagctgggactataggtgcgcactactatgccttttttttttgtagagatggcatctcactttgttgcccaggctggtcttgaactcctgggctcaagtgatcctcccaccttgacctcccaaaattctgggattacgggcatgagccactgagcccaacgtggtatattatctttttgatgtgttattagattcagtttgctgatattttgttgaggattttttccatctatgttcatctgggatatagccctgcagttttctttttgtgttgcatccttttctggtttcgatatcagagtaatgctggccttgtagaatggattaggaaaaatcacctccctttgatattttggaatcctttgaggagaattgtgttaattctttgtaagtttggtagaatttggcagtgaagtcatttagtcctggaatttattttgttgggagactttttattactgattcagtctcattattcattgttggtctgtttaggttttccactttttgattcaatcttggtaggttgtatgtttctaggaatgtatccatttcctctaggttttccagtttgctagcgtatagttgtttataatagtctgatgatcttttgtatttctatggtatcagttatactgctttttttttcatttctaattatatttgggttgtcttttttcttggttagtctagttagtagttcaattttgtttatcttttcaaaacactaacttctttggttgatcctttgtattgtcttttaaagtctattttatttagttttgccctaatctttctttctttattttttaaatattaacttttattccctactacacatagtatttttattattattattatactttaagttctggggtacatgtgcagaatgtgcagttttgttacataggtatacacatgctatggtggtttgctgcacccatcaacccgtcacctacattaagtatttctcctaatgctatccctcccctagccccccaaccccccgacaggcccccatgtgtggtgttcccctcccggtgtccatgtgttcgccttgttcaactcccacttatgagtgagaacatgcagtgtttcgttttctgttcttgtgatagtttgctgataatgatggtttccagcttcatccatgtccctgcaaaggacacgaactcatcctttttttatgccctaatctttattattttttttcttctatttatttggggcttgattttgttcttttctagttttttgagatacatttttgggttgtttattggaaatctttctagttttttgatgtaggaatttattgctataaatttccttctttgcactgctttggttgtatcccattggttttggtatgttgtgtttcaattttcatttgtttcaagaaattttttgattttctttttaatttcttccttgacccaatggtcattcagtagtattttttttaattccatgtatttgtatagtttccaaagttactcttgtaattgatttgtgtttttttttttctattgtggtctgaggagataattggtatgatttttatttaaatttgttgagacttttttatgtggtctattctgggaactgttccatgtgctgatacaaagaatgtatattctatagcagttggatgaaatgttctctaaatgtctattaggtccatttttgtgtaaagtgtagtttaaatccaatgtttatttgttaatttttttcccaatgctgagagtggggtgttgaggtcaccaaccattattgtattggaatctgtctcttcctttaggtctaataatattatacatctagttgtttctgtgtttggtgtatatgtttagaattgttacatcttcctggattgattcctttatcgttatgtaatgaccctctttatctctttttactgttttaatttaaagtccattttatctgacatgtgtataggtacttgtgttcattcttggttttcatttgcatggaatatctttttctgtctttttactttcagtctacatgtttcttcacagatgagatgagtttcttgtgggtaacagtatagttggatcacgtttttaaatccattcagccaggctgtatcttttaagtggaaagtttaatctgtttacattcttggttgttattgatatgtgagggattattcctgtcattttgttaattgatttttggttgtttcatgtatcctttttcctttctttcttactgtttatcattgtggttttgtggttttctttagtggtaacatatgaattctttctcttcctcatttgtgtgtttgctctaccagtgggttttacacttttgtatgttttcatgatggtagaaattatcctgtcacttccaagtgtaggactccctgaagcatttcttgtaggtatggtctagtggtaattccctcagcttttgcttgtttgggaaatacattatttattctacatttatgaaggataactttgctgggtatagtatctttactggcagttttttttgtttgtttgtttgtttgtttttttcctccttcagcacttcgaatgaatgtgtcatcccatcccattctctcctggcctgtacaatttctcctgacaaatctgttagtctgatgagggttcccttataagtgacttgatgctttttgtttttcttgaggtttttataattctctgtttgtccttgacttttgatagtttgattattatgtgctggagaagacctttttgggttgtatctgtttggggatccctgagcctcctatatctggatgtctaattctcttgctagacttgggaaattttcagctgttattttgttaaataggtcttctttccctttcatttttctctttgccttctggaacatgtaaaattcaaatatttgatcagtatattgtgtccaatatgtcacataggctttgttcattctttttttatccttttgtttctcttttggtctgcctgggttatgtcaaaagacctgtcttcaaattctgaaattgttctccttgatcttgtctgttgtctgttgttgaagctttttgaatgtattttgtatttctttcagtgaattctttagtaccaagatttctgtttggttctttttaatgatatctgtctctgctaaatttctcatttatatcctgaattgcttttctgatttctttttattgtttaatctgaattctcttataattcactattttttaaaatattattattttgaattctttgtcctggatttcataagtttctttttcattcaagtctattgctgaagaattattgtgctcttttgaaggtgtcatagttccttgcttttttgtgtttcttttgttcgcatgttgataatttgcacatctgatataaaattttcttattccagttttgggaatttactttcataggggaggatgttttcctgaagatgtatctatggtgttggttgtgtaggtcactttggctttgattctgagtatgtgaagtagtgtagtctccatataatttctttggctgtaaatgcatcagtagtgtctgtaatttttttttttttttttgagaccaagtttcactcttgttgcccaggctggagtgacatggcacgatcttggctcaccacaacctctgcctcctgggttcaagccattcttctgcctcagcctcccaagtagttgggattacaggcatgtgccaccatgcccggctaattttgtatttttagtagagttggggtttctccatgttgatcaggctggtcttgaacttccgacctcaggtgatctgtccacctcggcctcccaaagtgctgggattacaggcatgagccactacgcccggactatgtgtctgtaattctttaagtggctttgggtgtggttggttgtggaggctgtggcaaaggtttgctggggccggggatgtcagatgggtcagtcctgagcctcagtagtggcagttgcaggctgagcatgcctgttcttggtgtatgctggtaccagtgtaagaggtccaggcaggctgattcttgagcctccaggcttgcctgagtgggccaggcatgtgggtaggtccttaggtccctctgagtgtcaggtgtggtgtgggagatagcagtattagtgatggggcaaccctgtgggatccaggtggtccatactgtgttgacagtggctgcaacaggctgggagggccagtcgccaggcctgcagttggcacatacgtctgtgtgccaactgaggtgatagtggcagtttgggtgagcccatcctgagatccccaggaagtgtgctcaggtgccagtggtggtggttggggcagggtgatcccaaggcccctggatggcatgcttgagcactggaggtagacagtggagctgggccaggtggacgtgtcctcaggctcccaagtgctggtgctagctgtggtaggcaggggcggggtgatcctcagttctgcagtggaatgcttggtgggggtggcaatggctgtgctgtggtcctactgctggggagggcggggttgctttcagtggcagcaaccacagacaggtggttggagagcacatgcttcagccccaggtagcagctataagcagagtagcctttcctcagggcacttttaagtgtgttgtagccctgctatcgtgggcagcagagttgctgccaatggcagtcagctgtggtggtagatgtaagcagagggtgtcagtgtagcttcagatatgtggagagaggagggtcttgggccccttgggtagatgcagtttggtgggggctgggttctcaaagtggtgctttgctgtagctgcttaggactagagggtgagggggaaggtgggaattggcatgagctctgtctctggagtaacgctgttgcatggtctccaggcagctccctacatcagtttcagggcccttttgggttgaggggctctcctgtggctaggattggagtctggtgggattgtggaccactggaggtcacttcccctttccctacatcgaagagctgttccaggcttctcgccagtcccagaacagcaggctgccttgcttccctcttcttccttgccttaggtgtttcctgtcacttctctgttgaattctagtactcttttttaggtggtctgtttaaagtgtgactatctacttgctatttctgttctttgtggaggaggtgagtaccagatgcctctagtcagccgtcttggcttctgcaagtttttaatattcacaagaataatgtactgcatgcatccttgtgcaaattgctttagtcattagcatatttaaagctatactttgtttattttaactgctttatatctttctggtaatattgtgatttattccttcaccagttgataaatatttgtgttgcttttgatattttaaaagagtggcaattggaattcatgtgtctctcgttaggcacatgtgtgattttttttttaaactagggttagaatcttttgatctagtgtatgaacatgttcatagttagtagtttttgccaaactgtttttcaaagctattgtactaaattttactttcactagcactgtaggactgacctcactgactcttgacattttccaacttggtaatttttgccaacctgatggaaataaattggatctcactgcagtttgtaattaattctctgattccctgtaaatgtaattttcttttcttgtgattattggctcttaaggttttctcttctgtgaattgcctatccacatcggtgcccctttttctgttggattgtttgtcttttccctttttgacttgtaagaagtctttacatttcactgtagagaaagtctttcttatgtgtgtttctaaagtttctactaatttagtttttcttttcactcattagattttgcagcacagaagtcttaaaattttgattagtcaagttttatcgatgctttttggtcatatttagaaatattcccctcttcagagcttataaatatattttttcattttcttcttaaaattatattttattatatgtgtattttcatattgcctgaaacggatttctgtgtttaaaataaatattcagtttttaagtattattacatgaatgaacagatacgtcattttctcaattgatgggtaaaatcatatctctcatatcaagttataatatgtgtgtttcaggctctttattctgttccattgggctatccatgtatttctatgccaatatcacaatgtcctaactaccatcactttaaaatgtagtattcaataacgcatctagttattagttttctagttgtcttgggtattgttgttcttttgtgctttcatatcaatgttcagggagtctgtcaagttccatgagaaacccttttgggattttaattttatcatgttaaatttatatattgatactgggaaaattgacatctttacatctctattcacaaaaatattttatttcttcatttatttaggtttgcttgtatgcttttgtaaagtcagacttattcctagatacgttagagctcttgttactgtaaatgtgttctttcttgaaataataactagaatttttttttctggtatttttataggagcagttgattcatatggcttgatgattaattcagaaaatttgttaaactctcttaatacagtttgtttataggtgtcttgcattttctgtgtaactgattatattatgtgtggttaaaaataaggttttttaaaaatttccagttttttttttttttttttttagacagagtcttactgtgtcacccaggctggaatgcagtgatgctatctccgctcactgcaacctccgcctcccaggttcaagcaattctcatgcctcagcctcccaaatagctgggattacaggcatgtaccactatgcccagctaaatttcgtatttttattatagtagagatgggattttgccatgctgtccagactggtctcaaattcctggcctcaagtgagccacctgcctcagcccttcacagtgctgggattacaggcatcaaccaccacgcctgtccttgtttctgtttgaaagtgaatgcttaaatatgacattcatgtcatatttaaatatgatatgaatgttttgaaagtgaatgcttaaatatgacaattagtgtacatgtttgatagctacttttcaataagttagggaaattaattatcttctaattatagattgtcagaatatcatgaaagtgtattaaaaattgccaagcacattttccatgtcttttgagatgatcattggctttttttctctctttcaatttgttagagtggttaattatgtaaccacattttttaaatgttaaatcatctttgcattctggaggaaaccctatttagtcgtaagaaattgatatacatacaacccatttagtcatatatacacacaccccatcttctgtgtgtttgtgtgtatcttgaagatacatatttgatttacttgcattttatttagaaactctcatttatggtcttaaattagattaactcataattcatgttgttcttactctccttgtttgttcttgtaagatgattctactggcttcttatggggtaaccaaataaactgggaaaataagtaatagcaagtaattttaggtaggcttcagaacaaatggaagtagaatgttgagccacagtaacatgtaagatgggagtggaggcactggagagaaaacatatcaagggaagaggattaccttcagacttctagtcaagtgtgcatgttaaaatattaagactaagcattaaagaatagaaacaatgtataactcttgaaccaatagaagtggaaaagggagaatgcagtcagttccgttttgtctttaatcatttattatctgacattcttgggtctaatcctgctgtgaactgttctggggattctcacatgtggcatcctcctgtgtttttttccttttggaagatgagtttatattcagtgaggctggtttgagagaatcccgtgtggctggctgtgttgaggtctcgtcctccagagaagtttggtgtttgctagtgttaggcggtgagtgggaggagcatggggatatcaccaactcaggaccttggtttgtgttaatttcttctcctgagggttctcagacttgacaggtagtctaagttcaaatcccagccttgtgtgatttatgggactagagtcatgatttcttaagggactctttatttattttccaatctggagcctgagcttgacaaaacttccttgttcttcccagtgcaagtagggatatctttttttttttttttcttgatctacacacttaccaatacgaagatcttagagactgctagcttggtgggtgggtctcaattccaactcactgcctcagtcaagcccaagggctcatcttctgtttcccaatagtattaaagccctgtcctcatgatctctgacaatctgctgcctggacagcctttcaccttggtttaagttccctcttagcttagcagtgcatctaaggactatttattatactttatccagcacatcttagtgtttttagtgaatttttccattccttcctcttaggactgacacagaattctctttggaaatttgacaagtatgatgatgtgtaccttttctcagcatggtagacaatgggctataatagataaaaagtacttttattaacttacaatttatgtgttgcacagtttctttttgcatatgtgtatatcacattgatatacattattattttataagaagtagcattttatgtactttttcagataaacctcctaaaatttactagttgcatattcttcagcgattttaagtattctagtttaaaatcatttttagtggatatcagtattgttttgtggcccattttctagttattgtgacaaaacatctcactttttaaaatgtccaatttgaagctctaagaagggtgaggacttttttcttgttaatagagacttaatggaatttaattaaattctatgctgtctcttttctaatcttttttggagaaagaaaataggcctgattattttgaatttaagaataagaatttaaaaagtcttagaggtcatccttaccttaatttacaaatgagacaattgagattcagaacagttttggaacttattgaaaaacaaattagctagttgaaaatgagaatcagaaagagatctgctaaaccaaagctacaaatcaggcccccgccccggctcactctattgtattttaacagaagtggaggaagtaagttggtttgatttgatttatatcttattactagttctttatcagcatagattacagtctcccttagagtatctcagtagagtacatatttacattcatatctaaatactaaatcacattggtgtaattactagcatgtgagtttatgccaactgttccttcttcctcttggccaatgagtatgtaattgtctttcaagagatggaagaacacatcagatgtactgtgagtggctccatgccaggcacttgggtgcatcagtcgtactcctagaaggcataatgcagtgccatgcccaacctggtatcctataaacgttcaagaatgtgtgcatggatgaatgaattgcatggtgaaggtaaacaacatatgtgactctttagcgtttaggcttgacagatttgttataacttattttgagatcacacaataaggtgaggtaaatttctgagatttgtaacatctactctatagagcagccagtgagatcacttccctcgaaccctatcatcctaagacaaaataattgatgggtgagaaaagggcatgaatatgaacttctcttttcagttttgaggacaactgaatttgggaataatgctatcttatttatgtttttgtttcttgggcagggtgaaattctataacttcgtattacagagaagtttctaattatggtgatttggattttataatgagctttttggaaaagtacttattggactttgtatgagtgtatttttgttcttcccaaaatttcttgcaataaatatgagctactttctaaagatgaaaaaatcatctataatctcacctacataaattttacaaaattgtcattctatgtattgcttatgctttcctcctattttgcactctgtttttctccagtaatacaaaaagttgccattctgctttagtgtattattcagttcagtggtttttgaatcagcatatttaactttatttttgaaaacttgtcacatttaaatcatctcatttttacttgagtaataagagaaaattaatatgtttacattctgcttccccatttcaagtttttatctatacagtaagtaattttaatcccagattattattaaattgctattttattaataggtatagcttctttcaataattatttttgatatttgctttaagttttataaccctatgaagaacaattatttagaatcatgttctgtgggttttaatgcttgctgccagggtcttgtatttattgtgtgtgtgtgtgtgtatttatttttttcttttctcaagagttaaatactatatacactttctctacgaaggaagtgtagatgaaatgtagatggcattctttctgaatactcacatttctgtgactgttctttattgtcctcgtatgaaaacatcaatgtaattggctatgtatctcaaaaaatttctctgtataatgggtctgttctgattctctctgtctttagatatttgacttgttattttttttctctaaactcttacaatttttctttaccattgagatcccaaaatctcatcaagatacacctacattttagttgcttttaattaactttgttttgtaatctacataaatttaaatcactaatctgagacctttctttttaggcaattacttgtcttctgtttggagctgtgtttttcaggttccttctaatctttcttggacccctggtgcatcttgaatttttttcctatatgtgccttcttttcttttgttcttgtcatctctgactcttttctgagtgttgggtgaatttccttagtcttctacctgccatttcagttttctggaatttttatacttcctttcattacctgcattgccatttttaatacagaaattgtttttcagtttgttctgataggcacaataatggcttccaaagatatccattacttaatcctcagagcctgtggctactaccttgcatagagaaagggacttttcagatgtgtttcagttaaagatgttgagatggggagtttctcctagatttttgggtgggctcagtgtaatcacaggggtcatcaaatgtggtagagtgagaaagaagattgagtgtcagtcatgtgagaaagacctgactagtcattactagcttttgaagatgacaggtagccatgagccaagagatgtgggcagcctctagaagttggaaaagacaaggaaacggattctcccctagagctcctggaaagaaacagagctttgccttcccggtgattttagtcctgtgagacctattttggacttctgacctctaggactgtaagagaataaatttgtatatttatgctgctaaatttatagcaatttgttaaagtagcaataaaaaactatttttgtgatgtttttactgatttcttttgtcttcataatggcttgttctattttcaatgttactatgttaacaaaacacattgaggacacaaatcagagatgtcccatcatttaatctttttctctttctatctcttctttttttcccctcccatacatctgcttcagtgggaggtgatttcttctttggcgagagataagtggccacctcctttgattacatttttccccattatgttccataattatttttctgtcattatagccctgactatcttattggcctatagtccaattgcagttaaattggattctctctgaaccatgtaggttttctgcctaagtctgtcggctcctgaagaagtaggaaagcccattcacactgcccttcttactgccattggaggtgctttcagggtctccactgcttattcttttgacctgttgctttctgcagacaataagagaggaggtttaattcctctatcagttcagtcctattgtcataaaactaactgaaattcctctcacttcttctcaggcatattataccctcccaatttttaattcctggtgtattttctactctttcaatatttagctgctaattttcatgaaatatagcgttcttatccagaatcctcttagtataggattttaaatctgaactagaccttatgtataagttagtccaatttcctcatttcacagatgataaaattgagtttcgaaaatcatttaagttttatcattaaatatgtatggtttttatggtattacagtcaattgttgagagaaaagaaatggcataggacagggcacttttctctacctttagagaaaatctgtcagttttactcatctttgtacattgtggcttaaagagataatttatacttcttaattttgccatccttaactttatcgtttttctctgtgggaagggctaagaagctgcatatatctctgcttaactttgttgctacttggtgttcagaagttggaatgctgggaaataatatacgcttgatatttggtttaaacatttcttgattcagagaaggtagatggttatagagactaatgaaaagaacagacttttatatttgtcttgacaaagttttaaatatcctttgcagaaagaaaatttgtaaagtttaaacatttttggaaatatctttaatttattaaggaaatcaatatgtatttagcatgtagtccatagaacagttggatactatacaacaatgaataagcaagctagaatctctgcgtttatagggtttcatagcctagtgtagaggggatcaacagataattaagcaattatgatacagtgattccctggaccagcagccttggcattacttgggaccctacctcagatctactgaatcagaagttcttgcgggttatgtcagcaatcagtgttttacaaactctcaggtaattctgatacaagaaaccactgttttcactgttgagaaccagagttgagagagagagcacagcacattaaatagagctgaagctgagagtttggagtcattaatatcttgagttgaggctggagaggcaggtaagtaaggtctgataagatgattgaaaagtttagacttttatctaacgtgcactcataagcccttaaaacatgtccagtggggaaacagcttgatcaactttgtcttttttttttttttttttgagatggagttggggtcttgctttgttactcaggctggagtgcagtggcatgatcttggctcactgcaacctccacctcccgggttcaagcgattctcctgcttcagcctcctgagtagctgggattacaggtgcccaccaccatgtctgactaatttctgtatttttagtagagagggggtttcaccatgttggccaggctggtctcgaacttctgacctcaagtgatccacccactttggcctcccaaagtgctgggattacagatgtgagccactgtgccctggactgtgatctctttaagaagcagacaagtaaagagataaataattatacaatgtattaagtataatatttgaagcataatctaaaagctattaaagtctagataaggaaagagactttagatgcctgggtaagtcagaagactaaccacttaagtatttcacgttgttcttggaagttttagtgtacaacctatggatattcagtagaatatttgatcaaaaatagtggttaaaagtgtcatatgttttgggtaatttattagattcaaagcaaaataaaaatgaaaaagtagaatgtgaaccgtcttcaagatatattttttaattttaggggtcccaggtaaacttagagcttcaagaagaatgacttactctatgtgatgtatacttttctaatttctagtttgttacttattttctaattttgtttaaatatattattatatataattacatattataattatatataattatatattatatattatgatagataaataaacatatattattctgttttaaactgtctcaatcctttttaaagtgattattataaatattgtaaataataagcaaatatattcttatcaatgatgttgaagaataagtaaacatgttataaagcattttcactccacactttaaaaaatatgctgcatctaatctaagtatattttacttgtagaacattgtcaaagggtcacctactctttggaggttacgttgggtcctccaaaaagaaaaaaaattctcaaatgtcatagattggttgacaagtcctattctgaacttaaggagttgtgggggtaggcagtgctgaccacaggaatgttgagcagcaaatgctggctttgggcaaaaaacctttgatgcacagtgacttgtttgaaatgtttggaatgatggtccttgtgggaacctgcattacaaaatgtctgtcccacatggaacatactgtgtgagaatagaaatgcagaataatagggcaatgataccctatctagaaaccaactgtgtttacagattccctaaataacaggtcaaatagattttactatggtaaatattccaattgcaatgttctgcaaaatttttgtctgtctcatgtattttaagcaagatttcttggccatgtggcttttgtagtagacttcaatgacataaaaccactaagcagagaccttgtcatttatttaactccaactgcctttaatcttaaggacagtaatattgtgagaaaccttggagtttcaacataatcacaagatggtatgcaggatcaaatgttcaaattatttgcttttgtttttctgttgcatgtactataaaagtcttgtgttatctatataagctttaaatttggacctgtgccttctttttcatcatcttttctcctttttcttttagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggtaagttctgtcttgactgtaacttactttatagattctcagtgactaacataaaccacattattttatgtcagaggtaaccaacagtatgaatattcaccaggtaattcaccaggaattacaaggggatgaggcacctttatattaaatgtcagcttatgagtcttcctaaaattatagaattagcgttagggaaacatgggtcccagtggtgcagtataaatgatgatgatgtaaaagatgtcattgaagagtttggctatctaatattgaaaataccagaattaccagtcaaactcattcatttttcttacagcctaaattgtgaaacttttgcattgtggtttctgtattacatattttcagacagaaagtgcttttgtagaatatgaatatgcttccatatatagttatttttgttagtctattctgtaattgttgctacattataggtagtatatcaaggttttatatagatttactgaacaaaacagattggaattaatgatattctctgacagtcatcttcatgaaaacttccttattttctattaattttctatttgtagtagtggaggttaattcatatttcaaggtgaagagcaagatttgtagactcaaataccttctgcttttaaataagcattgtttttcttggatgaaaaattcatagtagtgatcaagaagaatatattcacttatgtgtgtagaaggtagttaaagagcacctactatgttctacgctctgtgctggctccatgaaaaggacagatacagacatttcctttggagctgagagtagagtgagagttttttaaaataattacccaatggaattatacattctccatagactatattcaggttaacgtttgatcacattaaaaaatcttttttgaaaaccttttatcatttcatctttccctatggaaattgaaaaaaaacattttatcacctcctctttccccacagaaattcaatggaaagttcctataattctctgtgctccaatttatatagcatttttgggtgaatgtaacatgggattatgtggctcctctgaaactctgggaattaccttaattttagccactggaaggagacagggtcctgctgatcattatataaagtagtattcagattgatgcataggtctcgtctgttttggttaggatgactgcatcatggacatcattttcagctatactcattgttgaccctcttgtagacctgtgagaatagcaactaagccttgggatcactgacacacctaaaaccctgcctaactaactgaaacactgaggaccccatcacctcagatatgagattgtcttattgcatccaatgaagattagtagaactacaaaaatggtttctctgtatgtttattaacaggaccttaagcacacctgtgccacaaggccacattttccatgatgtggataaaacacatctttgtttaccatggatgctatttttgtatgaaataaaacatgagacattaaataacatgagacttttttcctgtattgactcaaatatttatttgctgatgacctaaatgttggttgacattttttatatgcatgaactttttctattacgacaagtgctactcatagtttgcagaattgccagcagcaaatgactactgaacttggactattaacctgccaagttcttgttttaattttgacctttgtataatatcttgtgtattccagtgtgcaatgtactgaatgattcacatacttttgtgcctctttgggttgtttttcaggttgaaataatcattttgaggctataggagctagtgtttcagtgtacatttgccctaaatgccactttcccatgcccaactactaccactgcacaaccactaactttaaaataacagaaataatatttaaactagtatactccacaaagatcgaatgcagttgacatctctggaataaagagcatgatttttaaagctgtgagatggaagaactttcagaacatggaaaaccccgtcacggtgataggtgaaggtatttggtgaagaaagatgggaataagattgtaatataggaaacagaaattaaatggaccgtagcctttttgagaaaagtagcaagaataagagaatgggcaggatgtgggcagggagtggttggaaagtttagaatggggaagtcacaatcctaacagatgtttttcaaggcgtggtgcctaatgccattcctacagtatgctcccctatttgaattgtaagtgtccatccttagataggcacggttacatgggagacatgggttggtcttgtcataatgtaggcaaaccccaaaattggggctcagcctgggggagttcttggctctgcccaggaaagaattcaagagtgaaccaacagtgaaagaaagcaagtttgttagcgtaacagtgtacagccaagtgaccactccaaaggcagagcagggctatctcataggcagggtagcacagaacagcactaatggattgctggctagttatatttatacccattcttttttctttttctttgagacagggtcttgctgtatcacccaggctggagtgcagtggcatgatcttggctcattgtagcctggacctcctaggctccagcagttctcccacttcagcctctcaattagctgagattacaggtgcataccaccacacccagctacccagatttttttttttcttttttcttttttttttgtagagatggggttttgtcatgttgcccaggctggtcttgagcttctgggttccagtgatcttcctgccttggcctcccaaaatgctgggattgcaggcataagccaccatgcctgggcccccactcttaatgctaaatataattaaacaggttattcatgaacttcctggaaaaggggtggggagttcctgaaaccatgtaaggttaacttccaagtcattgccattgcatttgtaaaccgtcatggtgctggtaggaatgtctaatgcaaatgtattatgattcctggtccttgctggtttggattggtttctttgctacatcctgttttgatcagcagcgttgtgaaaacaagtcctgctggtctcccacttcagtaggaacaagaattctggtctactcgaagttcttctctttgtaaattagtccattgataatctggttattttactttagtttgtgtacatttggtttttagtatttgtcttcactgccagattgccaggtttgtgagggcaggcaggattgtaatgattgtttgttttctccacgttgccacattgcctgtcacggctatctggtacaaagtaggtagtcaataaatgctgagggaatgcatgtgatgacaaaaccaagtttctctgccttcaaaactgaagaccagagccgtagtgaattcactacagtaaatgccactttattcagctatgtgggagccaaacctagcgacacctttatgttctatgccttctaaaatacaacagcctggaaaactcctggctacaatgggtgctcagtaaataatatgtttgttttacttccatttattctgggaatgattactcagtttccattttcacttcatcaaaatgatccctgggttttagacctattcagtcttcatgatcaaaagaagaatttgttggtcagcaactgacttgttatgagtcaagttatattaaaataaagtcatctttgagattaataatgggcaataccaatggctggtttttaagcatgatcttgtattaagctgcttttgagtgagtactggatcttaataattatttttagttgtgaaatacttatttggcataaatcatgtgctaccttagaaattagtatttgtaaattacaaccctatggcgtataggtactgttattgatttgttatccttattttccagttgataaaaactgaggtaaggagaggttaggtaactctcccacagccacacagctaggaagtataggaacggggattcaaggtcaggagctgggattcaaggttgggcacttgggtttcagaacccatgtgtttgtcccctccatgttattctacttccctttaatcaaaacaactagcagcacatgctgtatttagttataacatttgaacagcaagcagtgtgtgctattaaattgaaacactgtgatctcatttgtttctgttgaaactgcctagctgtgctgactgggctttgtttccctgggcagagaaagcttttaagggagcaatcttttcttccttttgcttctgatgaccctcatttcatccacccttttccactgtttcatgttgcagcagcactaactgatggcttctgattgagggaggattttgttcaaggtatagttaacttgaaggttcattgccctagcataaagtcatgtaatccctccctaggcttgaagtctccctacttgacattttaccaagaattccttctgagtcgtttccactattgagtcagagtggccgtcaagatgttcttccttatttgaccatggcatgtcttgaattataagtcctttcctttttggctgtattctttgtgatgacacttctgtccaggatacttagagaggaggagatccagaatttgaaaagagaaaatcatggttaagatgtgaagtttttacatctgagtcctggggagagacataaagtaaaatgaatccaggtgtggcttacctctttggggaagaagagggagacactgtttttctagtttgttctggttggaaacgatcaccatggaagctaaattactccttatgtcttacattctctgtactagggtcagtatgcggccctactcttcctgtgttgtttatactcttacatcaaggagttacattttcctcattttacgttgagggaactgaattaggataggttaagtaacttgtctaagatcattctttttgtaagtggcagaactggaaatcagctgtcagattcttgtagaccatgccttttggccacaggacactgactcttcacataccatggtgactgtcaccagtggtgacgaaagtggcaggagtcagataagtttaagaccatagttttcttattcactctgatgaaagatttaatttggctactgtcctattagcaaatctatatgtgcttctcttttcagtttacttcaacaagcatgttgttgagtgccaattgtgtgctaagggataagagaaaaaattctttacagagcttatgatgtagtagaggagactaaaaaagagctgcaaagcactcgggttcatgtgctagtagaggtatgggcagagagtgatgacgagtggagtgatgggaggggctcccagaggaggcaatcttgagctgagtcttgctggatgtagaggagcttgcctcactgtagcattgggtggaggagaaggtgaccagttcatgagcaatgatgatcacctttgaggaactgaaagtagtcaggtgtgattagcacctagtaggtatgccagatggagttttgacaagagggtcaaaacctttataacatactgagaagtttgagcttctgtctgtgggagttgggagacgatgaagggttccccaagatcaaatgaacaccaattccttataggcagagtcctcacataatgtatcatccaaactgagatgcttttgggaatgaaaacaggcactaactgttgggaatctgggataacaggagtaaatcaagactgtttagggcaacctaggatgaatggtcaccctcctccaaggctctgctctctgtttgttcttttttttgttttagagccagggtttcaccatgttgcctaggctggtgttgaactcgtgagctcaagtgatctgctcacctcagcctcccaaagtgttgagatttcaggtgtgagccaccatgcccagccaatatttttttctaggttctcttttagtttttcaaatgcagctctcaacactggacttgtattgctgtgtataattggctttttttttttttaaggctggagtcggtccagatttagaattcttagaacttgaaaggatccctaaaaattatatcatccaactcccacatcttacaaatgaagagaccgagacccccaggttaattgagaacttcaggtcttagttagctcctgatccaagccaggatccaagtttcctgacttccactaaggtgctatttttactgcccctgccttgttcagtcccatccacactttccatcttcatctttttttgggaacttcagccatgtatttatgtggctagccaggattaggtgtaaacattgtggctgtgaaggtaactggttctcaaaggaagagtttccttgaataggtcttcttataaccaattggtaatctccctccctaattaaaccttgaaaaaagttatctgaaactgaatcgcttgtacattattagcatcacatatagtagcttttcacatatattagcatcctgttagctttcttgacaacagcattatgttactatttttcattccacttggtttttatattaagtttgtgctctctctctcctctcctctctctctcactctctgtgtgtgtgtgtgtgtgtgtgtttgtgtgtgtgttcagttatattcactgagtcagggcacctctggaatctactctttgacaagaactatctggatgattctgggcaagttactttccctgtgttaattttttccgtatgataaggtgaccaatttgatttccaagattacttaggattctatttattctgtaaataaaattataaggacagtaactactgtggatcaaccatgtagagctttctagaggaaaacttgaaaggggactgggacaaaaataagggactatgattcttctttgtatgaacggtgcattccaccttcttttttattttttaaggctagtcaagtagaacagtgggagtggagaaagaacaaagaaatctgtaattggttataatcaattagttgtacacgtccctgcactcagaccagccattaccttctctcataataagcttttagatgcactatcccccattaaagggagtggcgagtgtataaaggatcctctcaaagagatgaatctgggggctttactttcctgtgggagagccatgtggcaggaagggaagacttcccaattggtcctgttgctaggggcagggaatggacacagagtctcttattccctggccacaggtgaccggctacacattctgttactctgaaggggaactaaagctaccccatgtctcctcaggtcccagtggcatccctgtaaaggcctctttgaggaagaacctgagcgaatatccatgagagcctcgattgtttggccagccattaggctgcttggcaccatgggtggtggccaggagacagtccttgcaaaagtcccacagtgcttcccagaccccacatcctgggcttgggtcaaaacagaaaacaactttcaaacaccagctctttatacccttttgttgcccatctccattcaaatattttttctcagaagaaacgtttaaacagaaacagaaaccaaaaataccacatgaacctaacagagttccttttgaagtgtggacagaggaaccagaacatgaagctcttattttaggtctgttgagagtgattcaggccttgtctggccgagactcttgttcatccaaatatgaatgttggaaagtcatttacttttccttgtcgttaaaggtaataaatgatgcaaagatttcttaaatgaattgtggtgaccactgagaatcactgtttcctaggggttgagagtttagatctggagtaagataggccagagtttgaagttcacatcctggctccttgcttacgagttccatagtcccaaataactgacttaacctctctgagtcttggtttcagaattaacaaagtaagaatcatagggcctttctcaagtggttgtgagcattagatgaactgatttatgtaaagcacatacatgtggcttacagaagacacttaatggtagcaagtattatcattactcttaggttgtgtcctcatgagaattcccctcctttttctttccctttctcttttttgacacacccacatccattcacatctacctacacaccaagtccacgtataatttgatgtgcgagatggtgcttcatttctatgacatagtatgaaattactattgtgttccagcagctgttggctcgaattatactctgtaaatttttatcccgaatgaatggcctttgcttttactgcagctttgcctacaccctacttgttgagcctcagccctatgtatgaaaaatcctgttagcatcacaggaaatgctaatagttctgatctgctgactcttcagagttggttaaatggtgttgactattaaaatgaactttggaatgtaacaggccactttgtcaatgtctataagaaagtcatgagctccctcagatggatctgcagtacttaaggcacagctgaaagcccaggcatcatctagggcagtggtccccaacctttttggccccaggaatcactttcatggaagacaatttttccacagatgggttggaggaggggggatggtttagggatgaaatgttccaacttagatcatcaggcattagttagattctcataagaagcacgcaatctagatccctcacatctgcagatcacaatagggttcacactcctatgagaatctaatgccgccactgatctggcaggaggcagagctcaagcagtaatgcttgcgcatctgctgctcacctcctgctgtgcagcccgattcttaacaggctatggactgttactggtccatggcctggggatttcgaacccctgatctaaggcaccattctgttattctgtttccttttgatcagcagtgaagggccatgtctggcatgtatggaagaaatgacgaatggctgggttcatgagacctgattgctgttctctagccggtcctagcttcacagtttgaccacctgtgaatcctttagtctgggattcatcgtcatttacttacaaagaaaatgctatttattaataactcctaatctctcactgctacctcatgaatctctgtgaagaatcatcatggctgttctatgatgccagggctttatcttacttcccagcacctagaataggtcctggcactctagatatttgctgaatgactacatgaaatatacctcttgttctggattgggagttttacaggttgcctagttacaatagtaatatacccaggtagccaaaaattcaatgcgatttgatagtggatctcattcaaagggatatttgccataaggtcgttataattaagcagctacaactcctgcctctcaggactttttttaaggctaagttccagtgaaaacttcccgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaagagcttctgcacagcaaaagaaactaccatcagaattttttttgcaaacttgttaataatagtttattttgtcagcaaacatgcattgaagtcttctagactctctgttaatgagtatgactgcaaagatcaacaaaaatatgtatcctgctttcaagaagctctcactgtagcagataatgacagataatttaaataagtgcaatataacatggtaaataaacacaatataatatgacaaaacaggcaaagtgctatgtgaatgctgtatttcaccgggcaatgtctggaaaagacttcaagatgaaattgatgttggaatttcatcttagatgatgtatagaagtttgctaagtaagcctaggcaaaggaattatttctattagatattctttataccctgaattgaatgaaatattcaattacttttcttgtattgtaattagtatttcacttagctatgacaatagccgttgttaggcatgtacatcttgtataaatccttagagtggaaagggaagcttccagaattgtcagacaatatttacttagaactttctggctgcattttgcactggcataatattcacctttttttttgtttttgtgacggaatttcgctcttgttgcccaggctggagtgcagtggcgtgatctcggttcaccgcaacatctgcctcccgggttcaagaaattctcctgcctcagcctccggggtagctgggactataggcacgcgccaccacgcccggctgattttgaagttttagtagagacggggtttctccatgttggtcaggctggtctagaactcacaacatcaggtgatccacccacctcagcctcccaaagtgctgggagctaccaagcccggcccaatattcactttcttaattgactagagatagcaatttgacatcatcaaactggttatgaagtaaatgggttttgaatggttactgacctataaggaaagggattaatttatttttatttttatttttattttttgagatggagttttgctcttgttgtctaggctggagtgcaatggcgcaatctccacctcactgcaacctctgcctcctgggttcaagtgattctcttgcctcagcctcccgagcagctgggattacaggccaccacacccagctaattttttgtatttagtagagatggagtttctccatgttggtcagggtggtatcgaactctcaatctcaggtaatctgcctgcctcagcctcccaaagtgctggattacaggcgtgagccaccacgtccggtggaaagggattcatttctatatgtcagattaacatcctatggagaagaagaagggattgacagtgacgtgtatgtgtttcaggatctgaaagatcattgccaggaaaagtcgacacctatacctgaaacataacgagaatataattttctatggtgttttacagtctgtaatggcctggttgaggtttcagaatgtcttcaggtgttttttgttattgttacagcagtagaattcacaggcagctgtttcatctggaaatgtatagttctgtttttgaggggtttacgttctttgcaactcgaagcatcatttctgatttcctgatacagattgaaaaaatgagaatgaacataggaggcacacatatgaattgccgaatttagccaataaaaataattgcatgggatatacttatactaaaaaacaaatacttcttttttatttgaaattaaaatttaactgggtatcttgtgttttatctggcaactataacacacacacacacacacacacacacacacacacacacacacacattattggctgggaaatacagcattttagatagcaatcaattctatattacatggattttctcctttgtcttataggcttccatattatcctggagttcaatttaactatacaagaagtttcacttatttactatttctgcattttattttgagttgccttgaaataaaggattgtattcagtttatagaatcttgttttctcagaaattttgcttgcttatgaacaggtaatgttgtaaacttctgtgtcaaaattgaatttttcccttctgttacatagtctttgtcatgctctttgaaaaaagcattttaatgaaatttgtttttttcatataaacaatttttttcttctgttggtacctttgatattgtttttctttgaggcctaactagagcctgtgcctctgagaagctactttctgttcatgtattttagtgaagatgatagtgtctagactgaatgtggtcatggctttacttaaaccctggcagggctcctgcacccatagaggagttattataatgatccaaagcaaatatgaggttctaatagggtgacacagcaataacagggtctttttgaagaaatgggatttaatctggcattgggagactggaaattcatggcttcacttatttattctgcccaagtagacttttgttgacacaaagaacactgcattttaagttgggttttccatgagttcattctaaacaggtatttctgtgcttcaaaaagcttctcatatttatattgcaggcatgaactcattcactcaagttattttcctttctcttgggagagagaaggtagccacttaggagcctagccttaaagaacatgcagaaaagatggatgaagtgaacagtccagaaggttttgctgtagccagcaagtgattcaccattttatgctgaagggattgggtttgctaaccttgccaagcacgtggtactcctttgtatattggtccagtctgagaggaaaggccaagctataaattgaggagctggaatcagtgagtttctgaactaaagcaaaagaggctctatttagacattctttaaaaggtgtgtgtgtgtatatgtatgtgtgcgtgtgtataaaacgatcagacggtagagattagagcactggctttgtttaatttggcaaattctaatgttctagaagaaaagtgaagatgttttaattaaaaacactatttctaaggcaccatacatatattctagagtaccagtagatgagaactacttatttagagtggcagagcatgctatagaaacaaaatatgagtaattctaactgtagttatgttatattagcgtagtgagatagtaacattaatagaattccttagtggaatttcttaatgcttcagttcaatctaaattagtattaatactttaaggcaggaaatctgtccgaaagcatttgtaaatttaaaaagcattgaaatgagaagcagaaacaaaaaatattcatttctatgtattgctctatctatattatataactgatttactaccattaaattataaaatattacatgttcagtgtattgtccttctgcagttactgatttataactttaatagtaacagatgtagctttattactaggaagcttattgagatcatgggacatttagacccattgttttgattaaactttgaggacatttttgtactatctttataaatatggatatttaaatcagaattacagtaacattgatttttattgagaagacatttctagagtatatattattaattcactttaatcccttcaacatatagcacagttaaaatatttctagtttgctacgagtttcagatatagctaaaattttcatacgactaaaatctttgtgtatgtcaaagatttgtgtatgaaggcttaacttattgattagttttttaacataccaaattgcagtaactaaaccatctactattgtgagttatttttcctctcacgtttacttttccttggccttattttacagctaaattttataaaaaagatttgattcatttttgaatcaaatcaaatttattctaatatgtaataaactttattgcgtgcagtttggctgttttcagttttgttttcaatttttcctacttttcttaacttttcctaggtcaatatttttagttctgagagtttctaaaaagaaaatataataataatggttaacatttgagtgtttactagttttcagaactcattaagtcctactttgtcccaaattgagtataactttgagcaagaatcttaatctctctgaatttcagccccttcatctgccaaatacagaaaatatattttggtgaggatcatattggataatgaatgtgagagctctttttataggaagtgccacacaaatgtaagttatgaatgttttcgcagctgctacttatagagcagtgacccaaattaaaaaaaaaaaagtgtggaatgctaagtaaaaaatgtgatgtagtgtagttgcaaaggcgttagctgtattctaattccagatttgccacttactcgttgaattgactttgggcaatccacttaacctttacgacaacttctttatctgtaccacgaaggacttcgctacgtcagtgtttctccaggtgtggtccaagggccaccttgcatctgagtcacctgggacacttgtttaaaggctgatttttgggcctcagcccagactattgaaacagaatctttgtgttgggattcaggcatcagtacttacgtcacacaaaccttcaacaatgaccgtgtgaggagttgccggctttggtttaaattacatggcattcaacctgtccttgctcaattttaaaacccttttcaccttttccactgaaatgggcacatttttggtactgtgagtatccgtgattgccccaggcatgtgagtttgcacacttgctttacaggggagaggatcagaagggaaaaggaaaggaaaggagagttaggggaaaaaaaacacaaaaccactcggacaaaattcttggctcttgaagagctatgaaagaaaatagattgtttcacactaaatagactttcctctcaaaatatttgaaacatccacactaattagttttatcaccctaggaaaatttgtcacctgtaaattaatgtctgaaaatcacctgatctactaaaaggtatcttgagaaattatggggtatctaagaatgtttcaagtaggcatatgattttatattatcctgaggagaaaccatttgtttcccccaagaatgaggatggagcaacaatgtatatttatttttgcattaacctaatacaattgtatgtgtctgcatggaaacttttgtagaaaaagggtaaatcaatcatttgcttgttcataggctttaatttcttcctgagtcagcatggtataatctgaagagcttgggagtcggactcacatgtccttgtgtgcaaaaacccagttctgggctgggcgtggtggctcacgcctgtaatcccagcactttgggaggcctaggcgggcggatcacgaggtcaggagatcgagaccatcctggctaacatggtgaaaccccatctctactaaaaatacaaaaaattagccgggcgcagtggcaggcgcctgtagtccaagctactcaggagactgaggcaggagaatggcgcgaacccgggaggcagagcttgcagtgagccgagatcgcaccactgcactccagcctgggtgacagagcgagagtccaactcaaaaaaacaaaaaacaaaaaaaaaccagttctgatgacatgttaattgtgtgacctagagcagtatatttgacccttctgagcttctattcccatctataactgggtagagtactgtctcccaaatgaggagattgttgagaaaattagatttgttcaagtgcttagcatgctgcctggcacatgctgcggtgaatgtaatgttctcatactttacctgtggctcacatacatgaaagggccacctgtggcctgctgtgattagtggttggagctgccttcccaggatgggcattccttgaagttatctagcttcttttataggcctgtataatgatgagtggcattttcccattctctgcctgtacaaggtgatctgaaggttctatatggggattccactcgttagtttgtatatttatccagaaattcatcctctagtcattcattcaatcaatgatgtagaatcccagcaggattctataaactgtcatctatcaggattatgagactatcaggaatatgatgttcatacaatcttccaaagccaggcttgaattgtctatatgggagcaatgataagtggtttttcagcatctgctcaagcatcttggatacacggaccaatgtatcccccaagaggccagacaatctttatatatatggactattttatatatatataattaaatatatattatgtcatatatctatatctatatccaaaatctcaggaaaaaactgtattttggggtgccatccactaagcctatttgtctccttgggtgccataaagagcactgcaactatatacaaaccaattcagcgtgggtggcatattgcctgttgtgtgatgggaaaacaaataccaaaatgtataatccctattcacttacaaatatgactaaaatacagggagaatgggagtcagactcatggcagatgtaattatgaagcaaatctggccgtgacatgccaatgcctatagtctggtaggaaggatggcacatatacatagataattattgagaaaggcaaaaggtgacaaaagtaccataaaagaagtacaaataaagctgtatgagaatttagaggagagagactatcttgttggaagtaaaatcaggaaagctttatgtaaatgaattttatgtatgacttggctgttgacatacaggtgatgtttagggaatgaagtattagactgcatttaccttgttaagtactgaatcttattttaatcacatcacatttcctctttttttttttctaagagatagtgtattgctatgttgctcaggctggaattgaactcagtgggctttagtgatcctcctgcctcagcctcctgagtagctagaactgcaggtgcatgccaccacacccagcttactctttttttgattagcaaactaatgcatattcattaaggaaaaaaaagaaaatcatttagaattttaccttccataattaaccaaaatattaagttgaatatactgtttctttctagtcctttgctaattaatagtttattcaattcatataatgcataccactttatagattctttaaaagattgtcttgagcatttattatgccattaagtaatctttgaaagtgtgatttttctacccaaagttcagtacattcatatgatgaaatatataatcattagacatttacgttttcttttttttttttgctattataataacattaagataaatatctcttatgattccttcctcacagagtaatgaatcataatgacttattgttaaatgttcttcagaaagcttgtgccaatttatcacaaggggattgggagtcttttgtcacattcatgacaatattggattttttttagtggcactatgttacaaccatttgtgttatctttattcatgatgataaacattagcaaacctaaaaaagagatggaaactttttaaggatttagaaaccaagataaacaaaaataggaatgtatgtggccacataaaaatatatgtactcctttgaagtactttgttccatgtgaaagtctagtgtatatttacttctttagaaatctaaaggcctaacagctgaaaaagacagcgtggtgattaacagtgttacttttgaagtcccaacttcctggattctcatcctgacactactgcataccagcagagtccgcttgagcaatgtatccaatggctgcaagctccagtttccttgcgtgttaaatgagagacacagcagaaacagtaaaacctcaaaaggttaagtgagattattacacaaatgtttcctgacttagcggtggggttacatctccataaatccatcgtaaattgaaaatattgtaagttgaaaatgcatttaatacacataaccttggaacatcatagcttagcctatcctaccttaaacatgctcagaacacttacattagcctacagttggccaaaataatctaacacaaagcctattgtacaataaagtgttgaatatctcatcgatttattgaatactgaaatgaaagtgaaaaacagaatggttgtatgggtacccaaagtacagtttctaaggaatgggtgtatcacttttacactgtcataaagtcaaaaaatcctaaatcaaaccattgtaagtcagggaccgtctgtataagatgccaagtttataagtacttggtaggtactattataaaatacatgatacataacttgttttcatcagattatcatattgccatgctgaaatctaaagtccctgaattaatcctcattgtggcagatctttattatgtcttgagcaggaccagaccacaagggtcaggacccatgatgcttctaggactcagtggggcaagtctcctttgtattgagtggtgttgccatgtcaaagcatggacacagagaggagaatatcacacactggggcctgttgggggttggggggctgagggagggatagcgttaggagaaatacccaatgtggatgatgggttgatgggtgcagcaaaccaccatggcacgtgtatacctatgtaacaaacctgcacgttctgcatatgtaccccagaacttaaagtataataataataataataataataataataatataataataagaccttgaaaacagatatgcaactcactgctgagatcctttacttttctatcttccctagacaactttaatccctaagtaatattcccatgacgtctcagttcagtgctcatactgtctcagtttttttacagtgccccaaagctaaaagaaatacctaacagtttcatttattaaatcaacttaataagtatattcaacttaattagttaattcaacttaatacgtatataggtcctgataaattagtagccattttgtaaaacaaaaccatataaattgaaagaattatcatttttatctaatccttcatatttactaaggtatgtatgcacctgttgggcactgcacaacttttcaaaacttgaattcagattggaaaccaccatcttcattttctgttccacactgagttttatgtttacacttcatttttattatagcagatatcatattgcaaggacatgatgtcattgaaaggaatgtaatgccatttaatgttgaagcgctgaactactttatgctcgtagttcagagggtgtctgagagatgtcgagtgttagctgccctcaaattaaaaatatctagtagcattcctctgaattcactgtggcaccccaaggttcctgggggcacagtttgggaaccagagtcttacagtatttctggtttctggctttacttcagttttgttttctttcatctcattgactcttcttccccagttcctacttttatttcttggttccagctctctggttactttctccgctgctcaggtccgctctctgcatactcaccatcaagcagcagcagtctctgtaacttctggacctttgcagacctagatgcagccccgtaggctctgatgtggtttggtagctggctgtaggtcaattgatgtgttctaaattctacaggacttcttcagttcacaactccagggagcattacgtccatcataacctgccctaatggcatgcctttcatgtggctggccattagcttctgtctgtggcggtctccctgcaatgtgggtgggcttgtcctccacatcaggtctcctagctcactaggaacactctgctttataacaacaagaccacctgtatgctgagaccacatctcatcgctccttttcttggagtatcaacccggaaaatgtatttgaaacagttgagtggttaattgtggactccggattaacctgcttaattttttttatcataggtttactacttactctttaacttcctgaaacttcagattcctcatctgtaaaatagagataattgacttccttcatgtgagaatcaaatgaaaagttatgtgatgccctttagtcaatgtctgacatttattaaatgttaactgttactatatttttctgacagtaatttcgtaatttacttttaactattttaatgtctttaggaacagagtaataaactactggctcttaaagtttagtttgtcagttcatgagaggaaacataaatattgaaaggaaaaatacattcatataatttcctttaattaaactgagataagatcttgctctgtcacctatactggagtacagtggctagatcacagctcactgcagcctcaacctcctggtctcaagccatcgtcctacctcaccctgttttttgttttgttttgttttttgttttgttttttgaaacagggttttgctctgtcacacaggctggagtacagtagcgatccttgcttactgcagcttcaaactcctgggctcaagggattctcccactttagcctcgtgtgcagctaggactatagtcaagcgccgtaacgtctggctaattaaaaaaaaaaaaatttgttgttgttgttgagatggggtctcattatgtttcccaggctggtctgggactcctggcctcaagtattcctcccacatcagtctcccaaagtgctgagaatacaggcatgggccactgtgcctggccacatttggtttatatatactacaatatctttgtagacatattatctgtgatgatttttatgaaattgtaggtatgatagtgcagatagtgttttacccattttagagatggtaaaacagattcagagagatgacgtgaattactgaaggaaattaagtatttgctagaccccataccctaacctaggacttgtagtttcaatgctggtgctcattacttgctattttgttgcctttagtatttcaaaaggtaaaaacaaaagaggaagggaagaaaaaaaggaaaagaagattgttattctctgatgtctttttaaacaatgaaaatttgctatttctgctgtgtctagtatatataagtattataatgattttaattagtgcataaaaatcacaacagttgaaaaaaattgccaatgctctctcattagaaataatttcaaaagataaattgcttatcgaccttacttgaactatgcatccaaagcattgtattcatcactcagaaaagtataatgtaagcattggtaagtttgatttccagttgacagaaaaatgcttcagaaaaagagacaaactttcccttccccccattctctacttttccaaatattcagatgcctaaaccttccacccatgctagagctgttgctgcctaaccaccttctgggcacaatggcatggaaatacataatcagggtataattttgtgcagggcagagagaacatgctattatggaatcaagtctcagctgaatagcctggcctttggctgtgttttgatctcagtgctaaaatggaaatgaaacgttgcctcctcctttgtggcctatacaaagtttgctgattctgtgctcatttggtgattttcatgcccaagtaggtgaagggagaacaactacgtacatagatgtgcagctttggggttgaaggcattgatgtgtgtgtgctgagtcactatgacaatctaaagaggactctctggtggctgattagaaaattgtggaagttacaggctgtctgggttaaacatttcctggtttattggaggcagatttccttgggccagcaagcattgaaactcccacagtggtgtcatgtgatggttctccagcgaagcattttggatatggtgacagctgctttagtttaagtatctggaacatctaatgtgggagaacttggctaagtgatgtgagaagttaagagaggagtctgaagtttccgttacatttttttctgtttagtggattaaaaggcaattcccatgcaaattgtctctgtctttaggtgttgtattcattttctatgctacatcgcaaattgtcacagacttagtggtttaaaacacacccatgaattatctctcagtctctgtaggttaaaagtccaggcatgcttagctgggttctgtgcttggggtctcacaagctgaagtctgcgtaccagttgggttgcattctcatgtggaggctcgactagggaaggatctgcttcaagttccttaggttgctggtagaattcatttccttgtgactgtagaattcatggcaacttgcatcttcaaggccagcaatgggcggaggcagggggtgggcagagggagagagggagggagagatagagggagagagagagaaatctgtacttcttccagtctctggcctctgtgagagctcacttaagtcagtccaactgacccagggtaatctcccttttgagcaatttattgtcaatttaattacatatgcaaaaccccttcacttttgctatttgacagaacctaatcaagggagtggcatcctataactgtattctatggctagaagcaagttacaggttctgctcacacaccaggggaagggggactacacaagagtgtgactcattttggaacatcttagggtgtgtccaccatagatgtaccattttgagtacagatggaaaaaaaaaaaccagcttttcaaaaatgctgttttaaaggaattgatgttgttaggttgaaggctaaaggatggaatgttatgtatttaaatgtatacttagtttttaaaaagtttttgccaggaatattagtcatctgttaaagaatgtatcatctagtactttctttttgaagttttctttaattttggctacagagacattactcttctctgagtctcatatctctttacctgttccttcacttccccttccttcatcccttctgtttgtttttgaaatgctgcatctctaacctgacagttccttctgtccactcacctcaaggatggctagaaatcttatatccagaccgcttacttcctgaacacagtggcatggaaacacataatcatgatgtaatcatgagcctgtacataagccagctactctgttgggttcaggttgtaacctgagtgtctgcagaatggcctgtgggtgagagaccttagattgtttcaatctcactgttaaaatataaatgaaaatttattttctttttggtataggaaacatgctggtttcattcatgttgggtggttcttatgtccaatagcagtcttacataaacagtcttacagaagtgtacagagtatgtgcctgtttatttatacttaatcttttatttaaaaaaggatttggctggtgcagtggctcacacctataattctagcactttgggaggccaaagtggatggattgcttgagcttaggagttcgagaccagcctgatgacatggaaaaaccccatctctacaaaaaaacaaacaaacaaacaaaaaacaaaagttagttgggcatggtggtgcatgcctcttgtcccagctacttggaaggctgagttggaaggatagcatgaggcctgtaggtggaggctacagtgagctgtgatcgtgccactgtactacagcctgggtggcagagcgagacccagtctcaaaacaaagtatttaagacagcttaaaaagatgcattcagttcagaggacaaagttgagtttaaaataagcaagaaaaaggagggaaagggaaaaagaaatctaagaaaatgacatggagtcaggtaaagacatactttctagcagttaatgaagatgtaaaacacaataacgttcatgatttggtggccataaagtaaaatcaggagaaataacccttctaagtactgagtccaaagagacatttctcatttgggtattgctctgtgatggatgcatcagctatgatgtgatgttctggagagctctacattctttatggcacattcagtaccatgtcccataaagtcatgccatatcatttctcagtgaaggttggtggtctgtaaccaaagtgcagttcaatgaaagcaattctgtggggcttaaagatatagcccagtcatgtggctttctaatatattggttggctccctcaagaatcaggtttagcatagtgtttcttagtcttattaaaaacgtattgccctgcccctgaaaagcttaagaactttattattattattatttttgagatggaatttcgctcttgtcatctaggctagagtgcaatggcacaatcttggctcactgcagcctccacctcccaggttcaagtgatgctccttccccagcctcccaagtagctgggattacaggcatgtaccaccatgcctggctaattttttttttttttttgtatttttagtagagacgaggttgcactttgttagccaggctggtcttgaactcctgacctcaggtgatccacccgccttggcttcccaaagtgctgggattacagccgtgagccgctgtacccggccaagaacattttaaagtttttttcataccttagcttatatttgaaaagaagttattttatcttccaactacaaagttattacaatattgacaatatacacactcagcactagttaatctgccctcaacaaccttaaaaaaaaaaaaaagactttattttggcctatccaaaagaatgaattatatagttttccatgcatattgttacagttattttttccaagtttaaaaaatattatctttgttgctgacatctggatataccttttttataatttctagttaaagtgagtggagtttttttagggggtggtttgggagtaattagcattctctagagaaaactggaggactttaaaaagacatctgcctcattaggaggctgttccacctcagctacaagacagaagaggaaaaaaagtatggccaacccaagggtttctgcataataataatggtcttcctacggagggtctgagtgatccaggccacctgggtctgagtcacaaagcctgcatgcaatacttattattcactaatttatttctggttataaaagtaaatcgtatcctatgtcaatgttttatagtatacagaatcatttaagtaaggttacaaaagtgattctgaacttgaccaccaccattttgacatacttccatccagtgtatttttttcttgtgccaatatagcatagtggctaagaacaaaggcctctggaggcatccagatttagagtaagatcccagctccgtcattcctagctgtattgcccagagaagtttcttgacctctttgaacctcagtttcctcatttgtaaaatacaggcagtcccatctcgtaaggttattgccagggactacatgagaagtatattcaatgaggttattagcacagtgccaattatatgacagacctcagtagatactggctattgcatgctacatgtgtgtatacatgcatttaaatgtatatagtagtattatataattgatatcatactcaagtttcccttatcctttaaatttaacatctaacattttaaccataaggttatatcactgtatacttacctgtttgtttgattttagtcattcatgttattaccatgattttcatattgataatttgataacttatattgacagaagtgagaagtaagacactcagaagtaagcaagagaggaaaagaaggcacactcgttcaatttttcttctttctcagggtagtcagtgtttcgtttttgatgataacgtatggaaaaatagctaaaatctacatctaaggaatttaaaccattcatatccatttacatcttcataattccagaaatttattctaagaaaaatgagtatgtacaaatatatgattgtggttatatgtgtacatacacatgtggacatatgtatgtgtgtatatatacatgtacacattttgaataatatgttcacagattaaattctagagatggaattacagatacttttttgttgtatattctcttttttgagagacagagtctcactctgtctcccaggctggagtgcaatggcgtgatctctgctcactacaacctccacctcccaggttcaagtgattcttcttctgcttctgcatcagccttccaagtagctgggattacaggcacatgccaccacccctggctaagttttgtatttttagtagagatggggtttcactatgttggtcaggctggtctccaactctttacctccagtgatctgcctgcctcagcttcccaaagtgctgggattacaggcatgagccaccatgcccgacctgttgtatattcattttcaaatattctacaatatgtacttcttattctcatcatcataaaatagcaataaatattactgtttttaaaatgaaagaagataaagaaaaactatgaatcataagcacactttagagagtacaattatacagggagtttaaaaaccatcaaaattatccttaaggacaatgtctgcatcttaaatgagagacctcctagactgcaagtgcatgcagcttgcacaaaggggccctcactatcattctgatcattaaattctttttttttttaacttgcgaaatctgttttattcaagtttctttcaagccaagtggctagaactaaggttaggtttcatttttgagtatgagattagcagttgtcttagctcgagagctaaaacattaattttgaagcaggaaaggtaaaacacagaagtatcatctcagcaagcaaaataagctttttttccccccttgagtctttaatgaagaaaggaagtgaaaagagataaaaagaggcctgtctctgcatactgtactaggcatcttccatgtcagtatcagcattctgccttcctcgataagactctcagcctgggaaagaaggaaaccaagaattatcctcacaaccagaattgttctagagattttgtggaaacacatttattaaagactgatatagtttggctgggtccccacccaaatctcttcttgaattgtagctcctataattcccatgtgttgtgggagggacctggtgggagttaattgaatcatgggggtgggtctttcccgtgctgttctggtggtagtgaataagtctcatgagacctgatggttttacagggggaaacccctttcacttggctctcattctccctcttgcttgccgccatgtaagatgtaccttttgccttccaccatgattgtgaggcctccccagccatgtggaactgtgagttcattaaacctctttttctttataaattatccagtctcaggtatgtctttattagcagtatgaaaacagattaacacaaagacatttgtgtacacagtgataaaatggtttaaaagttagggagacagctacataagacaaagggaaacaggattagaatcaggcaaaggagtttgtaagttcttgggtgtggagcttgctttctcctgggaagagttgccttttgagatgctgtcatcctttgaggacaggaaccaaaggaaaaaagcaatgagggaacttctttttgtcccaaatcgcctgccaaaaataagtcagtgatgcttgtcaagcttggacgtgtcttgttcatacagtctggtaatagccagctttcttgtggaaaaatatagcaggcacccattgaacttcttagatgttctctcctctttgagcatgtaacctttcatctacattctacaaaatagccactttgatcttcctactcaacaatttaaatggatccccactgcctaagaaggaaagcagaaatctcttaccctaatgttctcgtccttccaaaatcacattgcagcctgtcctttagtcttattttccataactccacttcacttggtttgttccattcagaatgtgctttttgtttgtgggcatacttaattaggcttatctgctggtctactctgattattacatagttttgtaatatctaaagctaaaaatggatatatatatatatacttattaaaatgaacttgatacacatgtgtgtgtacatatacatatatatataaatacctttcatcaatacttttgcaaaactttcatttagagacttttagaaacaaattgtgtgtatgtatattatgacaggttggcactgattttaatttcttttaggataatgaacctttctgatttggctgacttgtagtagtggtaaatactacctgttggaaacctgtatttaatctaacagatgctctaaaagtctgtactttctatgcagcatggtctggcagaaaaacacttttggagtcagacagctcaacgcctcagttatgtaaacaagaggtatctacgtagatacatagctagattcctagatagatggtatctattatatcccagatggttttctaggtcagggaatatactggaagatctggatttgaatacagacttcagtttgaatggagcttgacaagtcaattactttcaagtttaagttcctcctctgggaaatagcacaaatagcacacatgacaccacttcataggatgtgctaaagagtaactggcttaatgctgttaacctcccaaccttgttcgtatgacagtgctttctgaggctgaaaatctgatcttcccaggtttgaccagttgctctgtttagctaaggtcagcctgtttattatttgggacagtcccaagagaggcaagattagcatcctttgaactgaaaggaacccttctcatctggagggtgaagaaggaagaacagaatgtcctggtggcatttagaatggaatctctagcccttctccttggacactgtttgcgtcatgaaaaaaactgtaatatggagacgctgtctccagcaagaaatttatggctatatttcaatagtttgttcaaatttagaccatgccagcttctatagttgatgaaagcctgaatatccaaacactatctccattaataaaatctcaatgttcccagaatgacgaatgtctgaaaacgggttttattgtgaaaggagaagctcatttggtgtttcctcttctctctttgcttttagaagaaaaaaatgagaaaactctgtagtcagccaaaaggtctttgccccctactaattctttttttaaaactgtcatgagaagataagagttttaaagttttgtattctatctctgggtcagggatcaaatatttgcatttgtaaagaaatcagaattgtctttgagaggtggagattcctggcaatgttcaagctcacaagttgcacaattctgtaatgtgaagtacttctagtcacctcgatgatggagagggtcacagcaaagagatctggccacatgggtggtcaaaagtaggatgtgcttagaaagaagttgtttttctttccattttctattattaagtatttaaaaactgtgatgtagtcacactgtttctgcattgatactgtgctttcctttctccctcccacagccctcagtaacccagacgtttattcttctatctacctaccttcacttcctatcacccaagggtttctgccttttaggttttctttagactgagatactgtctccctagcctttctgctttccggctggccgttaaaacaatcacccagcccttttctgtattataagtgttaattctgatctcagttgggaaataggcatatgggaaagatacaggcataccttggagatattgcagatttggttccagaccactgcaatagagcaaatattgcaataaagtgagtcacacaaattttttggtttcctggttcatatgatagttatgtttgtaatatagtctattaaatgtgcaatagtagtatgtcttaaaaaagtatgtgcataccttaatttaaaaacagcttatttctttaaaaatgctaacagtcatctgagccttaagtcataatcttttgaaaatattttttcttaaattaaaaaaattaaagtatcttaagtctgcttcttaatttttttttcaaatcctccactatttttttagataggatcttcctctgtcacccaggctggagtgcagtggcacagtcttggtgcattgtagcctctacttcccaggctgaagcaatcctcccacctcagcctcccaagtagctgggccacaggtgtgaaccaccatgcctggcttttgtattttgggtagaaatgacatctcgctatgttgcccaggcttgtctcaaactcctgggctcaagcaatccacctgccttggtctctcaaagtgctgggattataggcgtgcaccaccatgccctgcacaggtcatgatctttttgctggtggaaggtctggccttgatgttgatggttgctggctgatgacagtggtggttgctgaagattggggtggctgtggcaatttcttaaaatgagacagtaatgaagtttgccacgttgatcgattcttcctttcacaaaagatttttcagtagcatgtgatactgtttgatagcattttacctacagtaaaacttctttcaaaatctgagtcaatcctctcaaaccctaatgctgctttatcaactaagttgatggaatattttcaatcctttgttgtcatttcaacactgacaaccagaatatattctatctccagagaccactttctttgctcctccataagaagcaactcttcatccattaaagttttatcatgagattgtagcaatttagctacatcttcaggtgccacttctgactctttctcttgctctttctcccaaatctgcagcaacttcctccactgaagtcttgaacccttcaaagtcatccatgagggttggaatgaacttcttataaactcctattaatgttgatattttggcctcctactatgaatcatggatgttcttaatggcatctagaatggtgaattctttccagaaagttttcaactaactttgccaagatccatcagagaaatcactatctatggcagctctagctttacaaaatatacttattaaataagacttgaaagtcaaaattactccttgatccatgggctgcagaatggatattgggttagcagtcatgaacacaacattaatatccctgtacatgtccatcagagctcttaggcgactaggtacattgtcaatgagcagtaatattttgaaaggaatctttgtttcttagcaggtctcaacaatgggcttaaaatattcagtaagccatgatataaacagatgtgttatccaagctttgttgttccatttatagactacaggcagagtagatctagtataattcttaagggctgtaggatttttggaatggtaaatgagcactggcttctgcttaaagacacaccagccgctttatcccctaacaagagagtcagcctaccctttgaagcttagaagccaggcattcacttttcctctccagctatgaaagtcttaggtggaattttctctctgcacttattggtcagttatgttgtgaaactaacctgctctaaaaataacatttgggccagatgtggtggctcatgcctataatcctagcactttgggaagccgaggcaggtggatagcttgagcttaggagtttgagaccagcctgggcaatatgatgaaaccctgtctctccaaaaaatgcaaaaaattagccgagcatggtggcaggcacctgtagtcccagctactcgggaggctgaggtgggaggatcacttttgagcccaggaaacagaggtcatagtgagccgagatcacaccactgcactctagtcagggcaacagagccagaccctctctctaaataaataaataaataaataaataaataaatactttatttaataaatgaagcaaaacaaaaagaacactgatcacagatcaccataacagatataataatgaaaagtttgaaatattgtgaggattaccaagatgtgacacagacaccaagtgagcacatgctgctggagaagaggtgccactatccttgtgtgatacagggctgccacaaaccttcaatttctaaaaaatgtaatgagccagtgaaatgagctgtgcctgtacaggaaggtgctaggatcacgtaacttatactgttactgaaacaccaggggtttggtctaggtcctgctgcccactgcactgaaagtcaatcactgagatgccaatgtgatgtcaatcaatgaaatgtgagcacagtgaaatgagctgctcctgtacaagaaggtgctaggatcatgtaacttatactgttactgaaacacccggggtttggtctaggtcctgctgcccactgcacagaaagtcaatcactgagatgccaagcattgccaaggaagaaggcttttcttgggtgctgcagctgaggagatgggagctcagactcaaatccatctccctgactgactaaaaccacgggtttatatagaagggaaaaaaatagtcacaatgtgtaagaaataggaactagggaggggcaacgaagcagtcatgatgagtgagggatatggcatttggtacagtgatctggtgagtttcacttctttgatacttttttgagaggcctgaaggtcctttcccaagaaaggaactcagataaaataaatataagtttcaagctttaagacaaaaaaggtcaatttctatgtttatccaaaagaacagtctatggaacgatggggttggtttcaatacttccctggcatctgattggtagttctcgtgtcccttctgaaatggaaactataagactccttgaacatttttctctatgtgaccagaccagttcttctgaaaggatgctggtcacacctgccctttcccttcaatatagttctttccagcaagggcaactccaagagctggccctttgcattttcaaggcctcctaggaagtcgtattcatttcagggaatttctggtccacagaagaaaaggtacttcctcacagtgcttaggtaacttcactaactaatgaatctctctgaaagaccagaatgttccattcaatgcagttactaaaatgtatttttcctttaagattattctgctttatatttcccttttgatttctcttgaacataagatgtgataagagactaatttcagtattaattttctgttttaatactttatgatgaaaataattataattcagtacatttaaattttaataaaataacatctagacaataacttagtatcaatttaatatatagttaattataatatattaattaatattaatttgttaatagtttattaagcattaatgaattataaaagcatttaaacaaatgtcttaatattttaaaataatttaagtaaaatattttaaaattgcttactatttataaacatttagatatttaaaattaataatactttagttcctagtttaaatagaaaaatgttcctaaaatatgcataagggaaaaaaaagaaaagaaaaacacactgattatttatttccaaagaacaattaaacaagaagcaactgatgagaagcagaattatttgggatggatatgagccttagcctccatcttctgtagtgtaattttcttatgaatctgttttagcttttccctgaaatcagaaaagctgtgtgtgtgtgtgtgtgtgtgtgtgtgtgtgtgtgtgtgttttgtcaaaggttaagtctttcttttttgatgtgaaagttagaacaattaaaccgatgtaaatcaaattactgttctttgaatagtaagccatccttaccatccttatgctctctgtagttcctgctttttctgttttaatctgtgcattattattaataaaaatcattttcttctataaagataacatatgattagtacagatatattgggaaatattaagaatcaaagaaagaaaatagtaacctgtagtctcccatgcaaagacaacacatatcctttatctgagattttcctgttgtccagacatgtgaatgtcaagagagaatatagaattaatgaatcaaaacagttcctgtgaactcatatagatgttgctttactggaccctgatgtttaacattgttacagaaaagtcgggggtcagtctgattatgctccctttacaggtaacctgtttattttggctgaggtgattgtgtgtctttattcttatagtttattctctgttctctttctttcaccagagtctgttccattaaagaccaagaacgattaccccttgcctttttacagagctaagaatattagaaccatcagtggctcagggtctgtcaagtctccagtgagtcattctaggttgttcgccatacatttctgttcatcttagtttctctctgttcctctcttgattttttgccggacagaatattataaggaatatttattgtttgtgacattagggccatcaaattcttaaataagacttagtcctttctcagaggtagtattatccttttctcccttttgttaaagtgataatacgatcaatgtaatttttaacatttttcaaatatatatcaacttttgaaattagctgcatgtagtaataccagaaaatgtacattcatagaatttgttttgttcttaattctagattttttaagttacagaattaaaatgttaatctgaatcccttttgcatcaataaaggatttttatatcataatttttagaaacttccttcatccttaagttggccttcaaagcatatatatccaatgtcactccatagaaactttggttttacaagtaaatatatagttcatttactttatgtgatatatttgttatgttttgtatttgctgactatatgcattttatgtggaaaagcattttaatttaaaaagtttcattctagaagaaaatcagctgttttaaaagtattttgataactggttatgagccataatagtattattgttgtgaagcattttgtttccctaagtgtaagagtcaaacccaagaaaaatattttaatatgaaaaaatattctaccacacaatgatcagaatatgtacttttattagataatattttgaggtgaccattttggcatgtgttgggttggtactaaaaaatgaaaagatgagcttgcatttctagcataggctaaaattatggagatgatactcttaatgattatatgtctttaatcagaagttttcacccaaagaacacatggcttgaaataagttttttaaaaacatcaccagtgtcaacattatattatacaaattaagaagtaggattttttcctttttttaatgaaacacattacaccaagttgggaagggttaacattgtcctacatataatagaagacagagaatggaccagcaatgtagtcagaaggttgattctagagttccagggatcttagaagtcccaaacataagcagggagaattttggctttagaggtaacatctatcttgtccatagaacttgacgtatttttgtgccataacctttactaatctgatttcttgaaatgttttactttgtttccaaatccattgctacctatggtaaagtttctgacaaagagcatgctcctggattataatagctactgtagaaagcttattacatgtcacgtgtttgaaatacagaaattcatgtggttcttatagcactgctgtaaattaggtattaccatatccttttcacaaatgaagaaactgaacctcagggtattgagccaggacacgcagccagcaagtgcacacactggcatgttctagcccaggtatgttcaccactatctgtctagggaaaataattccatagaacataagagactgaggaaatgtatagagccttttaaatccttacatattactgataagaaaatgcaagccctttaacttttgtggtaaatggtgcaattaaggtgtttatacttatttataaaacatagcaggctgggtgccgtggctcacacctgtaatcccagcactttgggaggccgaggtgggcggatcatgaggtctggagttcgagaccagcctggccaacatggtgaaaccccatctctactaaaaataataataataaaaaattagctgagtgtggtggcacacgcctgtaatcccagctgctgggggaaggtgaaacaggagaatcgcttcaacctgggtgacggaggttgcagtgagccaagatcatgccactgcactccagcctgcgtaatagagcgagaccccttctgcaaaaaaaaaaaaataataaaaaaaagcaaaggcatattttgttttaaatgcatttcattgtccagtgtacccaaccatccatatatgacctagcacttctcaaggacaaattatcttgccacctatgcagacttggaataggatagcatggtaaactgaggaagaagtgagagcatgttaagttggtggaccatgattggcatcagccaattttcatatagttcctttagttccaaggatttgttatagttgatctaaaaggatgccgaatgaacagcagtaaataggtgaccctgctttgcttattggtgttccctaccagaggtgggaaagaaatgaataattcctctaagtggaaatggtccatgctccagtaggtttatgctacatttgaagtgtcttccttctgtcacttcctctcctctctactctggggtttgtgagagcttggagtgtgtcatacaatatcctctttggattgtgaactttcttacagttttcagagcactttgaaagacatctgaatcataagggataacacgggatggatgagaagaattaaaacctgtaataatgtatagaattatcactgggtgtggtccaggttgtctgccagacctacttctccagccactcctatttcaaagatgtggcagttaaggtccaggaatttctggtgatcctgattcctagttaagagtcagaaacatgctccagtctagttctgtctcagaatgaggtagctcctagtctaggactttgccatgaacaacttaatacttttatttatattgagtcatttgatatgcagaatcccaaatagatattgaggacttttgggattatacctctatttatttactatgtctttgagtatacctctttgaatagttttccttttggttgctatctcattacaatacacatgtgacttatcacagtctactgatatcaacattttaccactttgagtgacacatgggggccttatttccatttaaatgcttttacctttcccacttttaaatattattgtcttgagtatcagatggtgttataatgtttaagtcatctaatatatcttatgaaactcatgaggaggatcatctatcgtatgtagccatatttcagcttgttttgttgttttatttcctaatgctccatgattccatcttccatcattttctttctgttcaaaaaacttattttagccatttttaaaaggtctgccagcaacacagtccttttgtttctttcatctgtttctatattcccttcattcttgaagtatagttttcctggatatagaatttgaagatgacaattctttgttttcagcacttggaaaatgcaccttttccttctggcctatatggtttcaggtaagaaatttgctgttattggagttgatgttccctaataggtaatgtgttgttgctctctcagtgctttcaagacttttttttttttttttttttttgcaattcacttatcaaaattttaattatgaaatgtcctggtatggatttctttgggtttatcctgtttgagatttatacagcttatgaatctgtagatttatatttttttgccaaatttagaaaattttaagccattattttaaaaacaatttttcaagcccactctctttttctccctctattctggacctttgatgatgtgaatcttgaacattttgttattgtgctacaagtccttgagggtctgttttttgtcggtttttagtctattttcttcttgttcatagtgagtaaatttggtaattctgttgatctgttctcaggttcactgattctgtcctttgtcaccttcattttactattgaacccactaagtttatatttgttgtactttttagttttataatttccatttggttctttttttaatttctcaaaaaatacggaatgcgtcacgactttgcatgtcacccttgtgcaggggccatgctaatcttatctatgctgttccaatgttagtgtatttgctgctgaactgtgagcaccgtggttctttttttaataacttctagttcttggctgagattttctattttttcatttgtttctaaataatttacagttactcattacaccattttgaggatggctgctttaaaatctttgtcaataagttcttcttctgtttcatctctgggttagtgtcagttgtcatttcacagtcaagttgtgattttcctgacttttggtttgttgggtaatttttcattctatcctggaatttggctatgctgttaggagactcagagtctgatttaaatcttttgttttagtaggcagtcatcccatttaggtttagcaagaaaatcctggcctaattttgtgggccgtgcatccaatgacaattgcattttcagagactttgtggtgctattttggtcttcttggtttatctggggctgctagggttcctcctggcgtctgctggtgctacctgaaggggtggagctcttcagtagagcctcatgatgcctctgatggaggtagagggaatacaaacagatatcctggagacaggcactagtgctgaggactgcccctctctccaaggaaaacacttcccaggtggagcctttttttgtggcaggatcccctttgctagtgctgcaagccacctgctgtttctcattggaggaagggagtcttaggcttggtgagtaaggagagtgctttcctgtcttcttatggtcagcaggtgtattagtctcatgctgctaataaagacatacctgagactgggtaatttataaaggaaagaggtttaattgactcccagttccacatggcttggaaggcctcaggaaacttaacaatcatagtggaaggggaagcaaacacgtccttcttcacaaggcagcaggagagagaagtgctgagcaaagtgggaaaagccccttataaacccatcagatgtcgtgataacttactatcacaagaacagcatgagggtatccacccccatgattcaataacctcccaccaggtccctcacaacgcgggattatgggaactacaattcaagatgagatttgggtggggacacagccaaacaatatcagcatggctcctgctccattttccctggctagtaccgctggccagcctggtagtatcattgggactcccctttggtctgagtgggaatgagcctatttgggctggctacgagattgaggctctagaaacactgggcttgggtgaccttctgtgaggttgtgggttgtaagacactgtcactgtgacattcctctggttgtagggtctctaaccatttcaccttttggagttctctggcttccttttgtgttttttttctagggtttatatttatacttagctgggagaaacagggaaaaagtatctgtaccatcttgtccagtccagaattcttgtgcagggactatttttgggtagagttggggtcggagaagacccttaagactactcattatagaaaaaatgaatttagttagtggctttgtttcagtagaaagttctctatttttctacctttcatagttccctgtaaacaaaactgaaatgcagtctacctgccctctctcttccccctacttcgtaatcatgctgtgatatggtttggctgtgtccccacccaaatctcatcttgaattgtagctgccacaattcccacatgtcatgagaggtacctggtgggaggtaattgaatcatggaggtgggtctttcccatgctgttctcatgatagtgaataagtctcacgagatctgttggttttataaagggcaattcccctgcacacactctctcttgcctgctgcatgtaagacataccttgctcttccaccatggttgtgaggcctccctaactatatggaactgtgagtccattaaacctgtttcctttataaattacccagtctcaggtatgtctttattagcagcatgagaacagactaatacatgctgcctctatgggcttcaatgagctgaagttcttacatctttaggaacgtggaggaagagttaaagcctcaccttcagttttgctactcttgtcgtagtgggaacgtgagtcaacaaatactctatctttaggccacgacttctccttctgccttcttcctaatcgcctcttgtcaacttcaccaagcttaacttcacaggctgggaaaaatgagcttttaaagacagttagtcaaatcttatatgtcaaactcaaaaagggaaagaaactgtaagtgtaaatgccatctggctttatttactcatccgcccccatctcagaatcactttgagcagatgcatgctttcactctgaagagcagtttataggaacagattgaagaaaagatttgttttaaacatttcagcacgataattagattcaattaaatttgtcactaagtattctgtaacttaagatgccctagcccttggcacatatgagcaaaaatctaaaaaacacagggaaggtgctgatgaaggttttggatgagggttcaagtagccaaatactaccttcacttttgagataaatctaaaagaaaatttttaaggtagtaaatataactctgtaaaatacaaatagaattcttaaatttcaggaaacacccaaagattcagaaatgaatcatatttcctcatttgttgggcatttaaaatgtaattttatactagtgatagcaacagggtcaagaaagcttgggaatggtgccagaaactgtaacattaaaagtagaaaaacttggttcttccttagatgaatttatgtgtgactagaaatgctatgaaatgttctcaggtaggaaagtacttgcggcacagaagaaaatccctgttctctaggattttgggggagaaactttatcttaaattattctaggtatgaaatcatttacaaatgtaatttttattttaacatggtgggagtgagaaatacggaccactaaagatgctcacatccttatccctggaacaaaaagatacttttcagatgtgactaagttaaaggccttgagatagggaggttttatgctggatcattggctttgaagaaagaggaagggtccatgagcagtggaagcttctggaagctggaaaagtcaaggaaactgattcttccctggatcctgaagaaagaattacagccctgctaacactttgatttttgcctagcaaggactcacatcagatttctgacctctagaattataagataataaatttggattattctgagtcacaaagttttgtgataatttgttacagcagaaatagaaaacgaatacaaataagtgagttatttttaagagggttgctatttgtctcatataactttttatgtaaaagcattatctacaccactgactttgcccctaggaaaacatttggcaatgtttggagacatttttgattttcaccatgggggcatgggggtggtgtattactggcactgagtgggcaaaagccaggggtgctgctaaatatcttacaatggaatgaccagtcccacaagaaagaatcatctagccaaaatagagaaattctgagctaggttaatttatgtactcaaagcatactcttgctacccaaagtgctgtacatggatgagtaacattagcattacctgacagctgttagaaatgctgattctcaggtcccactccagacctactgaatcagaatctgtattttaatagatctctgggtgattcgtgtacacattgaagttgataaagcactggtctaggtgactttctcttgctttcttcctctccctatcatttcctttctcctcccttgctactccctgcacttacggttcccatttagctacgtaaatgcctttcttcccagcttcagtttctagtctcctcaagccaggtctgtgtattatttcatctctatattctcccaaagacactgactacattgcattgcacaaaatagctgcttgatattatttatggatcgaatgaacttctgaaaattcttgatgtagataattttcattttaactgaatggatggctgccatcatttttactttgtaattgaattcaaacatttcctagagtgtcaactatgaaaaaagatagccatttcaaatacctagaaatttcatagtaaattgaagcttcctaatgatttcacagtgtgaagaagagaactcatcctaaatatcctatattctgattcttgatgtgtaacaaaatgtagccagtatttccattcttaacattccattcttaacattaattctccagagcaatcatttgtgtaatggaataatttgtgttgtatttttaaaaaagaattagccgatgtttgtccaaggaacctaaggggattatcaggtttttggtatttatcaaaatctgttactttatatgatggttacaactacaaggaattatctcattttttttctttgcacgaatgcagtgaaaacactcataggatgttttggagttaaggtgacacacattacgtgaaaggcctgattttatgaatactgcatcttacagcaaaaataagaattcactgctacagaaaaggagcaaattaaaaattctagtttagttagccagagatttctcaggctgtaagtgatctccttcattttgtagatgaggaatttgaggcctagagaagttggtgctagtcaaaagatcaaaccgttgcatgttttgtggaaaggacaatattggaggcttgcttttaaacatagctgtcttcatctcgtgaacgtgtgctgtaaacccgatgacccttgagggccttgcaacttttgaaacattttaaatccggttctcccactctaaatatagcgttcttatagtttcatactgactctctgtagactatttctgtctggagaaaaggatgggtaggtggatggaagctgtcactacaatactagtacaaaagttagatttaaattcatgtttctttgcacacggtaatctacataaaaaagtttttacttcatatgtagatgaataaaagtgccaagttatattaattctctgataaaatagttttgtaattccaaagctactgggaaaagtccaacagacacatattttttaaatttctaaaagcaaaactagcactggaaaaaataacttggtccagaaatattggtttgtattgcttggaattgtaagcattgtgttgttttaaggtcctttttacccttcaggatagagccatggctttcactggattcccagaggcaccaatgtcacagaaatgagtcactagttttctcagctcttgaaatacgtatctgaagaccagtgaaaatctgacttgtcaagactatgattctaattactagggtttcttgagctcactgtttttgctattaaatattttcttccttcctccagaaattctgtgtttgaggattttatgtatcccttgtgaaataatccccagataatgaaaattcaacaatacaaagtgatgcagagacaatgatccttgacaacagtagtatagatatctgctcattaaaaaaaaaaatcaaaggccttattttagtctatatctagttatttttttctacttttcaatgtttctccctatctttctagaattagttctccagttgtctttttccttttaccttatgttgttttatcttcaaagacagagtgatggagcttagtaaggatgctatgatttgaagaacacagatgcctctaacttatggaagaggaagccaaatgctgttccacattcagataaacagatgaatggatgcaaaagtttctccctataagatgtgtttgtagttctgatgcataagaacttttccagcatgctaagggggttgaaaggtactgtattagtttgttttcacactgctgataaagacatacccgagactgagcaatttacaaaagaaagaggtttattggacttatggttcaacatggctgggaggccacacaatcgtggaggaaggcaaggaggagcaagtcacatcttacatggatggcggcaggcaaagagagagcttgtgcagagaaactcctgtttttaaatcagatctcatgagacccatttgctatcatgagaacagcacgggcaagaccctcccccatgattcagtcatctcccatggggtcccttccgcaacacatgggaattatgggagctgcaagatgagatttagatgggaacatagagccaaactatgtcaggtaggaaggcaggattcaggaaaataaaattctctgtctgattaaagagttcactaaatcacgcctgtaatctcagcactttgggaggccgaggtgggcagatcatgaggtcaggagatcgagaccatcctggctaacacggtgaaaccccatctctactaaaaatacaaaaaattagccaggcgtggtggcaggcgcctgtagtcccagctactcgggaggctgaggcaggagaatggcatgaacctgggaggcggagcttgcagtgagctgagatcacgccactgcactccagcctgggcaacagagcaagactccatctcaaaaaaaaaaaaaaaaaagatttcactaaatagttgcatattcaaatacaagtcacttaactcaccccctcccaaattttaagtcatgcttcagtgtattatgtgtttattacaagttcatacggtgcttaaatcctagtcttcaatctagtaacctcactatgggtaatccttagtgtactattcttgtggatcctttcctttgtttttcttgcctacttaagtgtagggttactttctagatcataccatggagtagtacaatggggaatgtcttaaaaatcaaatacttaagtgcaaaacacaaaataaggtgtaattcagtaacaatcagactaagcaaataaaaaacattctgagttgccttttaaatgtttcaagtgtgggttgcccctgataaatttaattaggcatcataaagagataacatataaatgcatttaaaagatgtaattgcacctcaaaactttacatagttaaaaatcaaaaggccacaaatgacctgaataaatagcaggagtctgaaaaataactgtcaaaaagaaaattgtcagcaatgtttttgaaaatataatgagggccctagaaagtacgcagcatagtcaaaaatctgtcgtggtaacaagaataattatgagcaggacttgaggttcttcattagcatcatatacctggattaaatggagcaagtacatttctccctctgatctaaactggaagcgagcactttactggtttacagctaaaggaagacaaaggaattgacccagcttacatcttccctaactaagtttttcactctgtaagcctgatctgattaagatttttgactaagaaatgaatacgaaatggatgggtaaatggcatgagaagcaagagaaatgcccaggtgtcccaaaggctgtctttccattcttcacgtggggccaacatgaagctcctctgggctgcatctggttctcttttgttgctactttatttcttaggaaaattatttttattgttttttagccagaactgttctgcaatgaaattctctcagcgctggcctttgcccagctgcccagctgtttctggagggtggggtccaatcttaccgaggtggccagagtgcatccagctccgaacaccccccagtcagtgctgttgtctgataagtctccaacagaccctcctgaactgtgacctgtgaaaaatagaaatatgaggcctgtgtgttcactccctaaagagttccctccctggcttatctattttcctcaaacatctcaactaggtcaggccctgtcattaaaaaacaagtgggtctcccctagtttcccggctaagaagatctggcctctgccttaggccctgactagggggccccgtgctgcaataactggttgtgcagcccacccagcctagtggccaggccccagtgtctgccccagagaggagaggttggagccagccacccagaacctttgctggctatgcctggctgtagcagctgttctggctatgcaactctgagcatgctcagagtggggcgtccagtacaccctgtcttcccaggctctctaaagccagaaggatttcattcttttccagaatgtggtactttagcaggctgagatagtccattcctcttagaaattgttcccctctacttgaaggatagtaaaataaaggaccatttaaacttttaaacttgactcttacctcaaattctttttcaaatgagattgggtctaaaattaagaaattaaaagcaaatattcattttatattctttttttattttttaagactaggtcttgctttgtcatccaggctggagtgcggtggtgcaatcataactcactgcagcctttacctcctgggctcaagcaattcccccacctcggcctcccatgtcgttgggacatgtgtgcaccactgcatctggctgattttttttttttactttttctggaggtagggtttcagctcgttgcccaggctggtgttgaactcctgggctcaagcgatcctcctgcctcagcctcccaaaaggctgggattataggtgtgagccactgcacctgtcccttatttttaattttaagcaaaaagaggactgactctgaagttcaagaagtcatcaagaaatgctgatgggttacttcagaattgtttcagattaaaggacagcctggtgtcactctgtgactatggtaatggcatagtagggaatacagcttcccactttgctatctctaggttaggagaaccaataacagttcacccaaaatatccacatttcttggaggcttatcctttgcgtattcactgaagaaggaaaggaaagaaatgaagggaacccattaggtggccctgtgcttcgtattccatttgcagtgtctcattcagtcctcacaatagtgctgaaagtagatcatatcctcatttgacagataaggatattgaggctgggcaaaagtgaataacttgtccaatgtcccatatgcagtaaggaaaagaaacagtatctgacctcaggtctgtctgtctctttcctcctataaaagatgaatacatacctttaaagtcctccaagttacccagcctcggagattaaaataaattttatttccaagatatctctatttttcttcctccccgctaactagcttcttaagttcccatgtgaatattgtcattcatttccttaattattaaacatgttttgttttaaactggtaaataatgtttaataaaggttttattattattttaaaaacatttttaatgaagttctttccattgaagcatttctaatttattctaatgaagcatttccaaagaataaagaaaagtaataatttagggttggttatctacatcaatatcattatcaaagtctactgtctgtccttcctcttttttcctccgtcttagaccagggagcatagtagatgaacatcatgcaggccagcacactgaggctacgtgtaagcaggtgggaagattatgtgcatgaaacagacagtcgcataccacttttggttacaaacacttgccctggatgagagcaggaattgagaccacgtttgtgtcccagtgggttccaggactttttttccatcagtttccaccctgtcctggacaggcttagaaaaacatgtttcttaccaaaaaaagttacaaaaacaatgtttacattaaaattcaaagtccatgcaactgcctctggttcctcaaggtaactactgccaatgatttggtgtgtatccttctagacattttttgtaatgcacatagggtatatatacatataagtacctatagcaattttataagtgacctgttgtacatgaggtaactttatagacttaatgtaatgtgcgtatcttcccatgtgggtaaatatgatagagcagtgccaatctgcttaatggctgcttactactccacttatgtatactatcagtggatattgagatagtttctaattttctaccgttataaatatttcattgaacattatgtggttgtatttttatatgcttcttcaagtatatctggatgacacatttctaaaatggaattgttaggtaaaagaggacattgtacatttagatagatattgccaaattgcccttcaaaaagatggtcaaatgactcttctatcaacagtatatgagtgtgtccatttatttattaccattatgtcactagtaagagcattttaaatctttcccactgtgctacctattctttttaagatcagaataacacatttaatactgatgagctttagttctgaagccaaagcgcttgctaacatttcatccctggatcaacagactcaaccacccagccacagatattgctggacaatcatgggtttccccagtaagggtgcagcctgcaccactaagcttattgagtgtttttgagcctgcctgcctgcatgcctgcctgcctgcctgcctgcctgcctgcctgcctgccttccttccttccttccttccttccttccttccttccttccttccttccttccttccttcccttcctccccttcctccctccctcttccttccctttccctttcccttcccctttcccttcctttcccttcccctcccctcccttccccctctctctctctttctttctttctttctcactctgtcaaccaggctggagtgcagtggcatgatctcagctgagtgtaacctctgcctcccaaaatcaagcgattctcctgcctcagcctcctgagcagctgggattacaggcacacgccacctcgcctggctaatttttgtatttttagtagagatggggtttcaccatgttggtcaggctggtctcaaactcctgacctcgtgatccacctgcctcggcctcccaaagtgcttggattataggcatgagccaccgtgccggcctgagctatgacctactttctacaggaaactagaagaagaaactaaagatagttggtgctggcctttctagtgttggtcaacctcttcctcattctctctctctgtcattctctctttcctactttattgaactataattgacatataacatgttgttgcatatattgatagtttgtttctattacagactagtattccattgattggaaatactactgtatattcacctgttgatttgtggatggacttttgggttgtttctagttactgactattacaaatattttgctctgggcatttcctacacatctttgtgtggacatattctttcctttctcttggataaatattgagtagaatggctgagtcatatgatatgtgaatgtttaacttttgaggaagctgccaaactgttttccaaataattaataccatgttacattttcaccagcagtgatgaaagtttcagttccactatatccaagtcaacatttgctagggtcactcttctaaattgtagacattcagtgggtgtgcagtcgtatctcattgtggatttaatttgcatttccctgatgactagtgaagctgatcgccttttcatgtgcttaatgcgccatttatacattttcttttgagaagcatctattaaactattttacattttaattggattattcattttattattgtactgatatgtaatgggaatctgacttttatatccctccctcaccccaaagtcaaattattccaagactatttattgagcatttgatcttttcttcatgttttaaaatatgtgttagattttgttatgcagagatccgtttttagattttaatgtgtgccactaatctcgtttatcctcctgctagtaccaaactagcttaaacctgtgactttatagcatgttttaatgagataatcccctttcattaacttgcccccacaaatgcgtttaatatacaaactaattttgaaagaattcctattttaaaagtattgaatcttccccttcaagaatatggtactagttccatttatttaggtattttttcttaaaagttatgtaatgttctttattgaagaataacatacttttgctagatgatgattatcttgcaaatatttattataagaaatccatttagttttgtactttaatttatatatgcccacttttctgagttacaaatttttttctaatagttgattgaatagttatcaggtattttagtttttctattaacaagcaggcaatctgaggacaacttattttcaattgtttatcacttttttcttttccagcttaattcattgactagaatgtcagtacaaatggatatccttttcttatcccttatattagtggaatacttctagtatatcgttgttaaataagatttctgttggtttctaataagttttctgtagttttccccattcccagattactaagtgttgtacttgtaattatattttgatttgttggtggtggtgttttatcttccttttaaaaaagtaaatgttgaattttaccaggcaagtcattggtgctaatattttttcttaatagtgtggtgaattgcattaagagatttcctagtgttaaccctttttggttggatcatagcattctgctaatataatgtcagattcaattatattcataaagttgactggtctatacagttattctcaaagaaaggtggtacttcctgctgactattctccagggacatttgggaatgtgagggagtagtttttgctggccacaatgggcagggtgctaaggaccctggaattcatggaacagttaatgcaacaaagaagcttttcatccccaaagccaattccaatcccactgagaaaaactaatctgtagttttgtgggggggagatttgttttgtctatttttttatagtttattttagtctcttagaatgaattggaattttttttaaatgttaatacttggggaacaatataaattccataggaagtaatatgttccttagtggtttgataaatttcatccacaaatccatctgaatctggtgccttttgaggggggtgaaggaacttttttaacgattatattctctatgttttttgttttgggtatattcagattatcaaactattacatcaattgtcatagtttgtttccttagaaaaacatcaattttagccattttttcaaatttattggcaaataatttcatgtaacttcttctagttgtgtgaacttcatcatctatggttatctcttcttcgtaatctgtttttattttgttggtcatatttataagacatttgtctctttagttgtttctttaaataccagatttgttgtcttaatcaagtttattcttttttatttactatttcagtaacatgttttaatttcttttttgcttttggggacgttatatatttttgctcaacttcttgagttaaatgcatggttcatttctttctcattatttgtattcatttgtaaaaatattttggcctctgaatgcaaaactgtgctgttaatggatttctagtctgttagatattccatttggatataacacaatcacttaattagggtatgtgatttgtattactagaaccaatagtgattattttgtaaccacaatatgctatttgtacagcaaacaagcctaaagctgctttgaatttccagcagctcagctggtatcctgttgttattaacagttgtaaactcaattacaattttacaattaattttaaagtaatgatttgtgacaaaaattctagtagtgaaaaatacacagtgaatctaccttctcacctcaatctttagccatggcaatactaatttctgatttagaattttttaaaattatctacatatataagcataagtgagtgtgggagggcatgtgtgtatctacatatacacactgagtatatgcacctattcttacctgacttttcttttcaccaacttaatgtggttttttctttctttatttatttttttattttttgagacagagtcttactctgttgcccaggctggagtgcagtggtacaatctcggctcactgcaagctccgcctcccggcttcacaccattctcctgcctcagcctcccgagtagctgagactacaggcgcccaaccatgcctggctaatttttgtatttttagtagagacagggtttcaccttgttagccaggatggtctcgatctcctgacctcgtgatctgcccgcctcggcctcccaaagtgctgggattacaggtgagagccactgcacccggccaatgtgttaacaatagttttgtaaaacatactaattcatgcccatagccacttttctattctcttccagtgaaactgcttcaaagagttgtatatccttgcagtattcagtttctttcctgctctctcgatgttactccaagtcaggagttctcatgactccactgaactgtcatcagtgtcctccttgccactaaattcattttttcagttttcaggtattttttacttttctcattctctccagtatccagtctgttagccatacatatcagctgtatggtcaaaatgtgtctatgatctccaccttcccatattcaaagccaccattatctcttgtctgatttactgcgtgagtttctagctgctcttcttgtatccacacttgctcttccagagtctccaaatattattcccctctaaaatgtatcttacttattttgtattttgttgattgtctttctcatttatcttagaacctaaactcaatgaaggcagattttttttttttttttctgctgggttcattgctgcatccctagtcacataactaatgaaataattacattgtctaataaaataagtacaaaaagaagacatcgtttctatgaaaattaggtgaatgctttgttaacattcaattaatgtaaattgggggaaaaaaagaactgatgaaaacaactgtcgaagtttggagaatccataaaaacactccacagggtttttcactgaaatggctttgcaagaattttaagttctgactctattctggaggagccaaattggaagtagtatgggatgcttaattggggttgcttttgcttcgaatatgacacagaactccagtcaatgcacctgtgttcaaataaaaagccttgactctatgtcaaaacattggtaaatgaatacaaatttatatttttaaataagatgtttaaagtatcatttttatgatttgttgttctaaacactgttagaggcattgaattttatcctccattaaggcttactgtagggcatctgatgacttggtatcagtaaagccagaatacctaaactgatggaattgaataggattctactttatgggtgcagtgtaccttattttacttctctatttatgcttatttaagttatttacagcttttaaaataaagaatactgcaaatctttgcacatgcataattgtattgtgtgtaaatatatctgtaggataagtttctatcagcgatattgttgcagtttatttagacagctttagaactgattgacttttgcttaggatttacgggctagtcagaatttgctttgcaatatttagacttggtgttgtcaattttatcagctagcttttttactctacacttgtacttaaaataattgaaatttatgtagaaaaaagtatgtttatgattgtgaatctggaattctgtagccgaagcacccacttcccaattgaataattgtttttataaccttactttaaggatttttttaatttagaaaaagtttttgataaagagagatatcttagacacatagctatcatattagaacagaccgtacctcctttctgctctgccaagaatctgtgcttcctaaagatcaatccagggcatttggcagctataggagatgtaactaatctcaaaaagaatgacagtgaccacatttacagtttatactgttcttcttttcatgtcttttggctattaaaaattatatttatataaatataaacatttttaggttatgtaaataattcacaaagttttctgaattcgcttttagattaaatttttaatattttccccattttgatagtaagaaaatgaattgtaaataaaatttccattacgtttctctatccttgaagtttctgtcttgggtaatacatatcttgtgattcatgaactgcaaagaaaaaaaatccacaggattttgtcatcagctacattctatgagcattttcagccagatttcagtacttgtttagatttatattattttgggagaatcttaatttgtagttaaaaaattaaatatgttgcaaaaccaattataaacttcctgttaatgttgaacttttgctagggaaagattctaaggggaatttcctttatccttttaaagggataaatattattcaaatcaccttagtaacagttggaccacagtcatgcaattagtttagtatcactttctaagttagatgatgttggtctggagttgacaacattgattttctgtgaagtttacaatttattattttttaaataagggggaaattttgctttttaaaacttttgcaatttatcacttagtttacgaggcaaaatagatttcaccattttgagaactgtgagttattttctatgtgaagaatatatgtggtaccattgtttttgattgggtctcatagtgcacattatgtaaaagaaaacaaatcttactgtcttttttatgatacagcaaagtgaagactgaggatcctgagtgtgcatagtgcatgcatgttatgtgttatatgtgtatgcatacatatgtgtatatatatagttttacaagtttaaaataatatcagtgacttgaaaattgtaagggcttaccagataatctctttgtaggccttggagtagcattgttttttttttttttttcctttggttattgatgggtaataatgctctggtaaatcagtcttttttttttttttgagatggagtttcgctcttgttgcccaggctggagtgcaatggtgcaatctttgctcactgcaacctctgtctcccgggttcaagtgattcttctgcctcagcctcctgagtggctgggattacaggcatgtgtcaccacgcccagctaaatttttttttttttttgagatggatttttgctcttgttgctccggctggagtgcaatggtgcaatcttggctcactgcaacctctacctctcaggttcaagcaattctcctgccgtagactccggagtggctgagattacaggcacccgccatcacacccgactaatttttgtggttttagtagagacagggtaataccatgttggtcaggctggtcttgaactcctgacctcaggcaatccacccgcctcagcctcccaaagtgctggaattacaggcatgagccaccacgcccagcctaattttgtatttttagtagagatggggttttatcatattggtcaggctggtctcgaactcctcacctcaggtgatccatccgcctcagcctcccaaagtgttgggattataggcatgatccaccacgcccggcctggtaagtcagtcttaaccttagttacttcaccctaagacagagctgggtagaaatcagaagacaagaattaggaaaaaaggaagaggcagtgacccatcttaaggtttagactgtattgtttgattgcgagtaaattaaagcctttccttttttgtatgcttatagacctcaggggtcacattctgttcctgagaatagtagctaccattggcaatgaagtatgtgtgcatacatcctggatctaattaggtggttgtgctgcttccatatttttggaacattattctgactttatttgttctatttgtagataagaacattcagaggaacacatctctccccatgtaattatctcatttagcattttgcctactcagagggcatggctaaatgttttaggtacagggaaaagctgactttggtggcagttctttatactgtcttctcaaattaagagggtcctctattcaggaatgtttcctgcataacgaatagacattccttgaagcatgatgaccccccacccactgcatttgaatgtagagcaacatcttacatggaaacagtgatagtataggaaacacaaaataacgtcaaataaactctaattaatagcttcacaaattcaagaagacactgtattgactaaattagtacatattactatgcaaaagtatcattcagagaacagtgttcctgaaaataaaaaaatctgatcgcctgccctcctttatccattactaataaacagacaaaccaaaagccactaccaagtagtgaaatggatatagctaaaaatcaaatatttgaccttgaaaataagtccacgatatcacccaggataccaaataaaaagtaaagtgttaaaaatacaaatgaaaaattaagagacatcaaggatccatcaatttttaaatgtagattcccaaatatccaacattcattgtaaaagaagtctcagatgaacagaaacaatggaaagaaaattactcaaagtaataggatatttccttaatctaaagacgaatgtgagactatagataaaattgccaatcaagggccaagcaagaattatgagcaaagccaagacattatattctagtgatatctgtgatctcccaaagttaatgaaagacattgtgacagtttcaggtaggagaggatgagaaaaatatttggttaatggcctaggttggtagctagctagccagatccttgttctttctttcacttattttttttattcattcaacaaatgtttatagagcacttactatgtgccaaaaattttgttaggtaataatagacacagtggagtaaaaatagtctgatgacagaagtaaacaataatcacattataaataaaaataaattacacctgtgataacttctaccatggagtgttttatagtgctgagagcatattacaaagggatttttgacttaatcagggaaggcatcccagaagtagcggtaagtaaagtgtgagtaggaattagattgcgaggagagcaggtaacatcccaggaagagagagcaaacacgtacaaaggcccatggttagggggattgtgatagactgaaaggaatggaaaaactaatatgtccagaaagcagacatgcagtgcaagacaaagcttggcgagtaagtaaggactcgtactatgcaggtgttttacacaaaaagaatgggaatcatacatcagacttctcacctgcaagactaaatactagaagacagtgttctgagagaaaatgattttaagcttatgcaaactttctagaaagaatgctcatggatacactctagaaaatgggggtgggggagggagaagaaaagagattccaaaaaaaagatgtacgttagaagaaacaatgtgccacctaggtatgtaaaataagcagccctcagtggaagctgagaagcaggcctagaaatcaatgggttcgattgggttagtaagtcagcgggctgcaggaaatgtctttggggataaattgtataattaaaaagttggaaatacatctgtggcatgcttctgctgtaataaactgtgtgtttcttatctgtaacaaaagagagaataaaaagaaaaagcagttagaagttcaagggaaaacaaaaatctgttcaaaagtcatggtgttgaatctgttttttagtaagagaattaagggcatcacatttatgatatctagtcacatgtttgggcttattcttgacattctatttacgtgtgtgcatttccttgcttttgcttctgtcttttcttttccttccttttgataaattgagttttcttttcaaactgttttgttcttccttcctttttaaaaaatttttgtttgtttctttagtggtttgagtggtacatccaatatctatttttaatagtggctaactttaaattttaaaaacgtactttaaaaaattcaagatataggccgggcacggtggctcatggctatattcttagcactttgggaggcgaaggtgggcagaacagctgaggtcagcaattcaagaccagcctggccaacatggtgaaagcccaactctactaaaaatacaaaaattaggcatggtggcgtgcacctgtaatccctgctattcaggagactgaggcaagggaatcgcttgaatctgggaggcagaggttgcagtgagccaagatcatgccactgcactccagcctggatgacagagtgagactcagtctcaagtaaaataaaataaaattcaagatataattcggtttctacagtagcccccaaacaagacaaaacttttagcaaactttctactcttctgcctcctcttcttaccttttacttaagaaaaatcaagacttctagtttcttgttgttaaaatttctaaatttataaatatctgaatatgagtgagttgaatatataaaaagcacaaaaagtaatacggcaatcatctaatgaccaaacattaaaatcaaacatgctaacattttacataatttgcttcaggtctctgaaaagaattgtagatataaccaaagcaccgtcccctactccttcctcctgcctgtcatctcagaagttgtccggaaattgctgctgcttgttctcattcatgtgcttgcacttttattatgtatctgtgcactcatttaaaaaaccctcacacttaaaaataatttggccaggtaatacaggttaaaattataggatacaaattctgaaccttcaaaagtgtgtaggaattgttccaccattctagaatttggtcttccagggtcttccttatgcccctttgaatgtcctatagcatccatttaaagaccttacacacggtagatgttaatgtttattttccacccgtaatttaatgacatttctacttattaatttttcttgtttgggatatatgtactaggcgcttagctatgacttgctaattcatccaatggaagatactgagtgtctgctgtcgccaggcaatattctagattccagagatacagacatgaaagaggtagcattccttccttcatgaagttaatattcttgttgagggaagataaaacaataaacatgtaaaccaataaatacaataattttgggtataaataaaggatatatcatttgggtatatcagcatgtgatgataataaaatgggagaatgtggtgatggtggtgggctgttgctctggctaggataaccaaggatagcctttttaagaaagcgacatttaataagtaaatagacataaaaagctgcagagagagtaatcccagcagatggatctataaatgcaaagatcctgagacagaaatgggcttggtctgtgtgactggaacctcgtaaatgaggagcgagtggaaagagatgagatccaagaaactagcagggccagtcatgtgtagggcattatggatagcagtaaggatttcaagtaggaagactttggagggttttaagcaggagagtgacttagtgcaaattgatttatgcttgttttgtacaagctggactttagggaagcagtgtggaggaagaggaattggttaagagcctgttgcaattggcagataaaaggtattgctcacttggctaggatggtagcagtggagaagtggttttacctggcttttcagcacctgaatggtctgtaagaatggcactagcattcaagtcatttcaatgtggactttccaaggtacagttgcaggatgagagttagagtctgttgtagggtatggaacttgtacgtgcgcaatacacactacttaatgttaaggagagtacaccagagggaaggcagctttggcattctcttgggcacaggaaagtagcattgtggtgatcaggagagtctaatgaagctaaaactgtcacccaggaatgttaaaaagagaacataatgagtattctgctctgctttagagctctgtatggtgttattatccttctctaaaagataaatgttgctctcaagagtgagtaatgaaaatactagagcacatcatacaataaatgaaatcatgaaactttaaatgtatgcaacatgtgctgtgaccaggaaggaatggcagtgttgaacaccaaactagatggagtaaaattggtatcagggtggaaataatatagaacaataatactgtggagatacctcaggtaaattatatagtttcaatagtcaggaaaaaagattttttaattaatctgggttattcttttagaaaaagcgttaatctcaaaaagccatccacatacacccccattataatgaacccttagctgcaagactggggaagaataagctttgcatctgtggccactttttctgacataggctctgttaagatacatagcattgaaggatttcctagctaactatgtagtatgtgtgtaccttaatagcagaaatcacaacgtaactacagagatgaactaaaatttgattagattctgggataccacgctgcctgacctgagggaataaacaatttagggaaaacagaaaaagcaacttaggcactcatttattttctcccttgattcccaccgcaggtctctgagatgggactgtttctgggatcctcatttgaaaaacaagaagagtgaggccaccttgggcacagtgctgttgtagaattgatttaccttgacttgttttggatctatgggatgtctggttcttttgtaaaaacacaactttgccagccagactagaaacgctttctgtgtttttcatcaaaaatcttggacactgtctctagaggtcttctctggcaaggactgttttcctctttaactttggttcttgcattccatatgtaagcaaagttcaactagttaggaaaaagtcattctagaaaaaaagactgtaattgtgagaccagatggtaagcattattcagctgatgaggttggatagatttgagggaaggtgtggtaatatgatctcgatctgcagctgtgacctgttgttccaaaacagcctcattcctccctgccttttgcgtctgcattccagcacctctccctccatctttgtgggcattggggttctcacagattgctttgacagatgcatcagggaggaataaagcttgttcaaggaagaacaacccacggatctgttttgaatatcctccaccccatgttacttgtaatattggcaaatcaggggacaatataaccacttttgttcagcgtgctgtgagacagtttcccatgacacaaattgccatgagcctatttagatgtaattaaggcatttccattagatgtcttgcaggtacctcaaactaaacacatactgaacccagctcatcagctgtcttcttctccttacctcccttacaaaacaccagtaaacattttctcctgtgtttcctccttcaaccaaagtgaaaatttagaagtcattctagacttctctgtctcatccatctcatggagtccgtctcctaaatacttctccagtccttctatatctcttcccagtgctgctgtcctgattctggctttcattatctctcttctggaatttggaaatagttttgcctttactttattttcttcttccactctgtcaccaatgttgtgtcttaaatgaaaatctgaccagtaaggccaatgagattacaatcccatagtgggaggtgtgggtgaaggtctttattttttaaagaagctctgcagactattgtaatgtgtggctagggttgagaatgtatgctggactggacaaatttcaaatagccagatatacaagacctttgtgaccttggacatcttatcttctgctacttctgtttctgatgttacaataaataaccacacttcttcatccttttttttttttttttttttttttgagatggagtcttgctctgtcactcaggctggagtgtggtggtgtgagcttggctcactgcaacctctgcctcctgggttcaagtgattctcctgcctcagcctcccaagtagctgggaccacaggtgtgcgccaccacgcctggctaatttttgtatttttagtagagatgcggtttcaccgttgttggccaggctggtctcaaactcctgacctcaggtgatccacccacctcggcctcccaaagtgctaggattacaggcgtgagctcccgcaccgggcccttcctcttactttcatactgttgcataccattcatcggtgttgtgcctgggtttgtgggattcttctatcagaaatgtgctggaaatatacaaactactcaaagcactatgactactgagtactatatttcattccccatcttggtaggtgatggcattgacccatgagaacctccaaaatgatttgcttccctatgttgtctctctattccctcttgttatcttcttcatacccaactgcaagtcctaggaatctctttataatcaggatagtattgtctcagagccttttgacatgccagctctttcttgtccaaaacacattttcacattctgcccttggagaatctatcctagggctctgcaacgccagcgtgccactcacgtaagtcatggtggtcaggtagatgcacagtttatagagggcttttacaagttgtatctcagtttgatcctcactgtgccatgtggaggaggcagggagctattatttctccacttcagaggtgctgagatggaggtgttttaactcttatcaacctttcaggtgtacgctgaactctctgtagattacatgttgatggggtccacaatgcacatctcaagtcctgtaacctgattgaattatggttagctccttactattaaaggggtttaggtgtggtttattattgttttcagaagctcaaggggaaatccttaatttgagcaaaatttatttcagaatatccattcattgtgggttaggaacctcatcccttacaattttccagcccccattttcgtcttctgtagtgcatcctcatcttttggtcagtttgatccttgaggcctctgtgaaatagaaaggagggggaggggggcgcagaatttccatatgattggttttagatgttgatttcggaggcctgtactgtgagtcactgaaattattggattgagtcttgaagatccaaacacagagtgttgggactgtgtggttgggcttaatcctagtacaaaaaccagttcctttcagtgaagaagataaaggagaggaatccaggttcctcaatgaagcatccatacatagaagctcctgtgtcaggctgtggtgtttcccacttcctgccttcagtctagcagggttccttgcatttcttggtctaaaagtaaggcttatgggctctttctggaaagatcttacaccttttaaattttaacatgggaagaaattataaacaacaaatgacagtgtttgaattctctcacttttgagcaaagtcaagcagcttaagtatgagagaataaagatattcccttctgttgcccagaaggagaaaaagatcattttatttaaaatctagctattgagatgcatgttccttgtgtctaatcaagttctgaatttgaactcaattagagctttgataaaaggaaggggaaaggaaacttgaaagaatgctgttccattcatgaagggactgtgtgtttttagtttccaagtaaatggcataatgggaccatgcattttccatccaagcattttccatcctgagaataattcccttcctggcttctcaatgaataatgcattatttctgaaacccaagaggcattcctttgattttcctttatgtttagctttctgagtgattttcaagcaaggaaattcaaggacttggaatgaatgctttattaacatttttattgaagttcaaattgctccttggctattatctcctgatatttgaaatatttttttctctccaaggaaagtctaaggtgttgtatttattagaaaatgaagtaccttggccaatcttcaaagtgaacagcagtttaaaaccaatacacatttgtgttgtagaacaaagagctttatgggggtacttttctcctttattttcatttccctgctgaaaagtttcacaaaagaaagctcagattcaaaagtgggctgtttggagactaaatctcatttgtttacattttgtgaaactaattccttgaggctggaccaaatccatgaccccagtccaagcctgcatccaccaaagccagcgccatttaaatctgaagatgcaaatgcccttctggggttgctcctacttccgctctgcctgattacacatatgtagcctgcctgattacacatatggggcccattaggtgaggtgtaatgggacacagtggtgcccaccgctgttggctcatgttctttcagtagaagatccccagcagagtctggagtaacacagtggtaggatttaatgctattttacaacctccattttcctgggatccaaatgatgagtgatttcagaaactaaatgaaatagaattaagcatctcatctatattttcattcctcttacagttatagtaaaattgtaatgattcagaataattgggggaagaaagagaacaaagttgatctaaattagtagaacatctgaaatagtaaatttggtttaaaatatttaatgttatcattttcaagatatagaaatgtaatattttctagagcttgaactctggaggcagcctctaagaacagaaactctgggatttttctgctttccagtactgtggccttgagccagttatataaactttctgggtctcagttccttcatctgtacaatggggatattagtttctatgtcatatggctactgtgaaaattcaataaattattactggtaaagcatataggacagcactatgtgggtagttgttgaataaaaataaaacatagatcttgtcattgaaaatcacaatttccaaacaggcccatgctactcagcaggtaataattattattgttattgtagatacagattgagtgattatttccttaacacttgtttaatccatacaacaaaccttatgaggtgtaaatataatcatctgcattttcagatgggaaaattaaggaaagaaagtagtttgcctaagttcacccagtttattacatgtcaaacaaagatttgggcccagacaacctgaatccagaaactatgccttaattaaacattaaaggacacttatcattcgtgcttatcttttgcctgaaaataacactgctattaaaaaccatgttgttatgtgaggtgaagtgtttcctgaatgcagtttttcatatctcaattgcttatcaaactctttgtgttttgctcaaaataataatcatcaatgtctcataattgcttgattttagtaacgtccaaaataaaattttaagttgactatcgttaaattttttctgattttctcaggaaatgagtatttcatttgcgacaatggtggcttccaacttcagtatttttatattgaactgaaatcatttcactttatggtcgcatgttttataatattttttcattctctttttaaaaatccttctgatccctatccttgtccttgtaggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatc

SEQ ID NO: 36523 - DNA, 164822 bp, Homo sapiens; identical to SEQ ID NO: 36522

SEQ ID NO: 36524 - DNA, 115830 bp, Homo sapiens
gctcgccgaggcgctggtgcacgggggcagcgcgcagcaggccggcgggcaggcgggcgggctggctggcacgcaggactgggatcgaggcccagaaaacggagcagcgggcaccagggaggcctggaacggggcgagcgccatgagcaacaaatgcgacgtggtcgtggtggggggcggcatctcaggttagtcgcggctgtgcgccctccttcctcttcacgcgctcggacaggtggctgcctgggggagacgcggggggcggccgtggggcaggggctgaccctggagtccccagactgtccacgcacgggcagggctctagtgggtccagagcgccgtgcactgaaccctcctttgggggcaattttgggtgcgttcccggacgcagaggccagaggctggaagcctgttgcagctctggggccagactttgaacttctcccccagaaggctgctaggccttcgcttgctggaattttcgaagccagggaaaaggggtggggaggtggcacaaaggtcagtcatttgctccaacttgacctggacactccgcaccctcgcttagagcaagcatgcaccacatcgtattgttgtcctggcgtcaggaaaacgaccttgaacagaagaggttggagcctggccaatcgattgccaaagactttccaggccctcctgattctttgaggttctgtgattgtcacggatctaacttgaggctgcagtgtctttttggcaaatgcctgttttcctcttatgcctctcgcacccccactccaccccaccccactcctagcgcagggtggccaagctgcagctttgctctctggcctagcccatatttggcaaggatggggacagacactaccccctcagccacacggggctgtgtacataccaagggcaccgaaaaatagaagccagaagaagggatgggggtagtggtggaacttaccctctgtggaggatcaggcagatcctatgggatagggtcaatgggaatcaatgatgctctcagcacagcctgtttaatggccccctgggcatgctttggcccacctcctaacgctgcctagtacttgagcagtaattaggacacctccagacccgtggatgcattgtctaagacttgccttaaggagttctcaagtggcctttgggaagtagaggttggccttgctccctgccaggagggcaggacagagttgttctgactctcctgtggctggagaaaaaaccaaggcattggatgtttggtgctgaccatggtccagtcctcctgcctctgctccagcctttctcccctttgggtgggatctcaggctaccacatctgtctagcaggctctggtgagctcgcccatgccaggccctgtgcctggtgttgcaggtacatagatgcgtaatcacaacatgctgaggttggccaaggctgtgtataaattcagttttctttcagtatttttgacatcttctctcctagaggaagttggacttaaaagcatacctacttaggtgttttagaaaatattactaagtgcctcttgatgctgccttgcatagcaccccatcttacagaagctgaagtttctcttttcaggcccccgaagtcattttctcactaaagtatgcccaatggattcagatttttctattttcccttcatgatttgtccctttctgattcatactccacaccttcaggttcaatcacattactcatgttagactcatctggaaaaggtagataagggtttaactatttttgcaagcagtggtgaaacctctgcattcatcctcccgaactctgatcaaaacaaggtactgatgagtagatctgacttttctcaagaacattccacggaataggcattgttctaagaaccaagaaagcagccttccaaggcccagtcttactcaattgcttcatctgctacatggggataacaccagttagtcactgctggattacagggcaagtgaaacaatgtgagtaaaatagctttgcagagtctgaaatatggcacaagcccctcaagagttttacccatttattcagacaataggaattgagggaggctgtgtaggggattcaaaaatggatcatgttgttcttgccccggaagacttgtcaattcaagaagggtgatgggatactcagacaatacaaggtagaaggtggtgcgtgccatgggaggggtccattcattgattcattattcattcattcaatgaacatttacttcctgttccacattttgtcccaaaagaaataaaagatgatttatacagggccattgttcctggggccctcacaagctgatgtggaagacagtcaagaataattactactctttggcatatgataggtgctttaatagtgcatataaaaaattctagggaaggtgattggagagaacatcaaactctgtctgagaaaatctaagaactcacagagttggtgacatctgaactatgtcttcaggaatgaatatgaattcaccaggggactagatgaagaaagcatttttaaactaaagagcagcttgtataaaaccacaaatatgtgaaagaacatgctaacgtgtaggataacttaagaacttcattgcggagagttgccagaggggtctggtgggagagaaagctagaaaagtcagttgggatgaattatggggaggcttgtatatcagaaaggtttagctctttctgtgatcaatgaatagcactgatgattttttattcagagtgccatgcatcaaatggcgtgtgtcacatctgatggtgatattagcaaaaagagggatatgaagaagagggagagaaggttttgggaaaagataggacgtctagagttggaggttctgggaggacacccagggagagaaatctagcagttggaatgaaattggggttacaaatgtgtacgatagaggttttagtagatgaaatggccaaaatcaagagtgtagtgtgtagaattttcgaattagtaggtgaccaacacaatgatttatgtttaaaagtctctggatttgactctgcgttctaagctttgttaattattaaacttgggacattctggcaattccctgataatttttaaagctgtcagcaaattttaatcactccctttgggataaacagagacatactgggaggatagctggttaatacataactttcttttttgatgttttaaaagttccaagatagttgtagactaactttttagaaatgtgtatggtgtataaatgagtatgcactgaaatctcttttacccaaggggcagatcatctccagagacttggcagagcaatgacatctcccacatggaactggacagcagcacgttgcatctgtcccgcgtctctcagttttagtgtttgggtgggtggaaccatggaaactatcttttgcaattctggaatagttcttgttcaatccccaaaataaaaactaaaaaaggcaacttgaagcagaaacaagaaagttttggccagacttaggagaggagatttggtcatttgagggtggcaggcacttgtttgagatccctggaagtgttggaaccagacttccaaattgtaaccaacacctggcaggtgatctttgtggcagggagagcaagcctggctgcaggctagtggtactggctttggcagggaatgtcagagatggctcacaaggggttatgagttgaggtgtgtggtgggcagatgtggcccatatgttaatggcaaagcctctttctcacctttggtgaagaaaaatggagaacttccctgggctcctgtaacccacttgaatgtcctaaaaaataataattatatagatatgcctgaaaatttgtatatcctagtcaaggaaagaatacacagaggtaatacagcaatattaaaagaacatacgatttatcttggaaggttgagacgggaggattgcttgagcccaggagtttgagaccagccctggcaacgtaatgagacatggtctccacacacacacacacacacacacacacacacacacacaaaggctgggtatagaggagtgcacctgtagtcccagctactctggaggctgaagtgggaggatcacttgagtccaggagctcgaggctgcagtgagctatgatcatgccattatactccagcgtgggccacagacaaagactgcctataaaaaaagactgggagggggagaataggcttagtgtcaaacacactagttatgaatctcatttcttatgcttacctatgtggaaccttaaaaggtacataacctccctgtatttcagctgcctcatctttaaaatgagactcataatgccttcctggccggcttgtttcaaggattggaaagaatgcacatgtaggaccataaacagtgatcacttcggctttggcttataggtgccttactctacctttttggaaatatatccttgtttgtcctgtagagtttttcaatctaagggagcaaaaacaggcatttctatgtaatcacttcttttcaccaaccaataatttttctggatgtgcagcatagataaggtggcaacaggacgccatgtatacatgtgggcatcaggagagactcgcctgacttcagcctcatcctggctcagccaattcctttatccccccgcaaggggcctgaggaactcaggctcactttgggctctgagacccactgggttccgcttcaggagaaattctggaagtcttagatctgtacttcagcctcacctcaacctggctattattccaattctgatctggtcttcatttcagccatttgattcctgtcttaactacaatagaagataaatgcattaataacaaatgatattatttatttaataatattatttaataataaatgataaaaaggtagcatatcaagcgttatctacatgctgtacaaggtgttaggagcttgattagaatgacaaaagctctgtgaaggttaagaatgacaaagccttgttctttctgcttgattctaacacccctgggacacagtgttggggccggttggtgggctgtgtgagtagagccagttgccactagagtcacaatttctaggcccccatgtgtcctcagaagtcaccagggcaggtttaaggcttggcttggcattgacaatggtcacaattttcttctcctctgactgggtattgaggtctaggctccctgccatacattcaggggcagtggtggagcataggggttaagagcatggtgtctaccctggttccaccactaactagctgtgccaccttgggcaaaatagttagttaaccttcccatgccttacttttctcatttggaaatggggataataatggtatctatttcacaaagtggctgagagaattaaaggagaaaatacatgtagagtgcttggaatgtggcttggcatttggcaggcacacaatagatattgatgattattgttcatcaggctgacaaaatgtccactagcaactagtggtctgaagtgccagtgtgccagcttcctcactgtcaaactttgggctgaggaagtggtttgtggctgtgcatttgaatgcactgacacacacacacacgcgtgcatgcacactcggagaacattagcctgtaacagagattctgcttccaagccctgttttcttggcttgtatatgatttactaacacagatgatgtgagaaagtcagcagcttaatttaaacaaaaggctttaactctaattattttaatatgtattttaagagataaatatgtcagaaactataaatgcaaaacatttgtatacgaagaggaaggaagataacacagctgttaaacacaaagggcattggaggcctgggacttgggctcaaatcccatctgttcccctaaatgtggagcttgggcaataggggtggcaatagtaacaggttagtttttttgtggagttcaattacagatgattttcatttttttccattttctgtaatttacagattttcacaacaaatatgtattatttctgcaactcacgtttccagaaacaccatactcttccctctccaaaaaaattcctcaaagtataaatcaccatgatggaatgtgactgcatctttcatttatatcagtggcttttcttcttaaaaatatttgagggaatttttgttattaataagtgtggttattggccaggcatggtggctcacacctgtaatcccagcactttgggaggccaaggtgggtggattgcttgaggtcaggagttcaagaccagcctgaacaacatggtgaaactccgtctctactaaaaatacaaaaattagccaggcgtggtggcgcatgcctccagtccgaagctacttgggtggctgaggcaggagaatcacctgaacctgggaggcagaggttacagtgagccgagattgtgccactgccctccagcctgggagacagagtgagactctgtctcaataaataaataaataattaataaataaatgtggttattaattcttcaatttatccttctgcaaaagatgccctgctagatatcaaaagctctttcaaagagcttgtctcttcaatttgtcttggtacttcttcagccaagtttcttcaatttttcttggtacttgaaaagcgggtgagtgttcctgggctaactcctagaattctcaataaatgttaactttgttatttgtacaagtcactgggcagtactcaattgagggcaccctggaatcatgcaagatcgaatacccttgaagggtgcaaaagtgagccaaattgaggggccacgttcaggtgtaatatgtgtctgaagaacgagtgttttcagccccacaagagaatgctttggaaatttgctcaggttaaatgtgtaccattgtgcttttgcaagaatctcattcgctgggcttaacttattagtagtgtgtctgcataaaagttgttatttcccctaagaggaggccataatggtataaaattccttcctgattttgaatattcaaggaacaaacttagaagaccaagctaaaaaatactttggtttaatagaatcattggtgactgaagacggaagcatctttagagttttacctactagttaagatcgcctggttttgcatccaagaaaaagcacatttagagagtgcaaagggctggctccagacctcacagccccttcttttgaataaaattattgtcctggaggatgagccctcagccttaggagaaaatgcaaacagaaggacaacctgatcaaatggtgctgggtgagaggttagaatcactaatactttgaatgcactatttctactttctgttttcatgctcacaaaatggatccatctttggcctcctctgttaactcagtaaataaagatacagaaagccaagtccctgttagcaatgtttcctaagtcagcatgcatttatttactgaaggaaggtatagaaaaagagtaagactaagttcccagcctcaggaaacttaaaatgcagatggagacacaagactagcacatacatgcaataaggaacaattaaactaatgtataattgaattctgaactgtgggacccaaggactaagttagaagaatcattaaagaccccaggagttggagaaggtctcattaagggagtagaatttaacagattctgaagaacagtccaggtttgggagggtagagaagagagaggctttaaagatgagaagaatcatttaaatcatagggccagagacttcagttagcaggtgatctttatatttacaggacagtagaaagtccagcttgtctagaataaaaggaaggggagacatgggaaggaaagttagtaggaggggggcaggatccaaaaacgagcaattgaaaaacaaagtgaaaagttaggttttcctgtggtaagaaatagggagccattgacagtttatactataaagataaggtggatggtcgtgtgcctgataaccagggaagccaaaacatggatagaaattcaggaaaggattgagaggtgatcagctgattataatgtattgggttattctgaatgcccaagggaggtttcaagagaaatggggatagaaagaagggaagaatgagtagaaggaggtgtccaaagttgcacttggctttcttcactgtcttgctggcagcctatccagaaaagaagtatcacaaacaataattagttgtaatttaatgaagttgtaggcactccataaaacatttaccactgttactattgccacctatattttatttttgcaaacttccctccaaagttttatcattgggattgaaggacttgactgtatttacattttttcttctttaaaaaactaaaaacagagattttcttcccaagggctgtgacccagtttactaaatgataaaacgtgtatctctggcaatctcaaacacaaaatgaatagttcatcttatttgttatataaaaactgtcggccgggtgcagtggctcacacctgtaatcccagcactttgggaagccgaggcgggcggatcgcgaggtcaggagaccgagcccatcctggccaacatgaagaaaccctgtctctactaaaaatacaaaaattagccgggcgtggtggtgggcgcctgtagtcccagctactcgggaggctgaggcaggagaatcgcttgaaccagggaggcggaggttgcagtgagccgagatggcactactgcactccagcctggcgacagagacagactccatctcaaaaacaaacaagcaaacaaaaacgaacaaaaatgtcatttaaaccttttgttttgtgagagaggggcaccatcagaaaacatcttcaggtaggtctgacctttcaaatgttagtcatcttaccatagtctccatttaatggcatcttaaatgtcatatactatctaatttccacttcatatctgaaatttgagctcttgatcttatgttatgcatctcttagctaggccatttttaattctactctcctcctcaataacatttatcagaattacacaatgatgaaaatgtcctactagatacttagttttatttgctctccttctagcctaaataatcgtcccttttgcttaacctctccaacatttttaatgattcttttaattgaatttggaatccttacttcatattttgaagttgggctactttttattgctgtgatcccagtggtgtgtgtgtattaaattgtgtattgataattatgtctttagttatatctcatttctttgggttattttccagttttctacattaaagaaacaagctcattggaagagcttttgttatccagcaaagcatcttttttcagaaggataaagttaagaattaataaccaatttagttaataaccaaaattacttcaaacatttggtaagaagaaaggccactgatagaaatgaaagatgcaatcacattccatcttgatgatctacagtttgaggacattttttagagaggtgtgagtatcttttttaatagcatgaatgcagaaataataaacatttgttgtgaaaatctgtaaattatagaaaatggcaaaaagaaaatgaaaatcatccataattgaactccataaaatatttaccactgttactattgccacctatattttctttatgcaaactttatgttgtatttactgtacttatttgtatcccctttaaaaataaataccaacatgttatgaatgtttacctatgtcttaaatgttttttcatgattttataacattagttcatatgattgtatcacaacttgttgaatcaatctcctattgctgaacatttgtgtttttttcaaactttctgctattttcaacaaagctgttatgaacctaaattgttgtacataattctgattgtttctttaggaaatttccagagataaatgttagaaattcttttaaggcatttaataattatagcaaaattgtcgcccaagaaagttttaccaatttaccttatgatggaattgtaataatggacttcttagccatttcaataggaaaccaacatttcctccccacccaacgatcccccagacagtacagagataatcaagattcttcaccagtttgtagtcgtaatttaatgaagttgtaggcactagaaattaaaaatatcttcagttttgtaacattttagtggtggcaagtaagttttgctctctgtaacatgcaggaaagctgttttttgcaattactacgttatgcctaccattatctactgggaacatatacttttatagtacttttaaatttattgggtaccatctagcctgtgcttccagaagtttgccatcattaattagataactgttgtgtttctatgcagaaaagaaaagaaaatagtcctgtaacaaaccattttctatgattaattatttttacccatctagataaaacatgagtatagcctttgttcacagcctattgtaacagctgatcaaacagctgtttcatgttttacattttaatttcctctgtattttgcattcaaatcctgtgatagagtttaatttatttaggaaacccataagatatagtcgactgtttcagaatagcccttttatgctgtgccagttagtggaaatcaaacagcccttgttaagcaccgatgataaatacacataagggtgtgcactaaaagagttgtcctcgtttcatcaaatgtatttccctatgtcattgtttctgcagggagaaaaagaaatttgttcattcgttgattcagtcattcaataaacccttatcgagtgccctatttaccaaacattgggctaggtgtgggaatacacagatgggtaatacatgtgcccatctttcaggggtacaccaagcagaaggaggcagacatgtacaggtgaatgttctgaggggtggtgggtgctgagaaagacatgcttatctggatcagatgagacagagaagaggaggacagcagcttcacctcaagggcctcagaggccctgaaggaggatttggcaatggaatttactggagaggtaaccagcaaattcaaatgttcttccttgaaatatagctttaagtagttggaacttaaatctatattctaatgtacatagagtgttgaaatttcactttcactctttgtatagtggatgttatagtaggctgtcccactaccttcaggacctgctgagagtgttggctgctgctggctcacagccaagtccctctctgaaagtcacccttgactgaagggagctgactaacccaggccttcgtaccctcttgcttcaatccaggataactctgaaaggccacattagcctgagagttcactgtaggactgattgatttctctgttgtgcttgcatctctcagttcaactccttcctttgcccaatcctgcttcctttcttcatacatgttgaaccccgataaagcttctatatgcaaacccatctcagaggctgcttaccaggggaccctaagctagacagaggatgactgaacagcatttttgctcagcgtgtcacaagatgttctaatcatgaagtttcagacagttggaggaagaagcaattaaagggcatgacctttcccatgttcttttcttttctttttctttctctttttttttttttttttttttttttgaggtggagtctcactcagttgcccaggttggagtgcagcggtgagatcttggctcactgcaagctccgcctcccgggttcatgccattctcctgcctcagcctcccaagtagctgggactacaggtgcccaccaccatgcctggctaattttttgtatttttagtagagacgcagtttcaccatgttagccgggatggtctcgatctcctgacctcatgatccgcccgcctcagcctcccaaagagccgggattacaggcgtgagccaccgcccatgttctttaatggcctccaccaaggatgcaagaggccggtagggcctggagacggtgcttagtctcatcagttctggataagcactctttggtgccctgagagcccccaagtaagggtgaaaggtagaggttgatcactatgctggcccaaacactctctggggaatcccaatctcttaccactctgtgtgctgattcagagctgaaatttagagcctccgatctggaagtgctcaaaatatggattccttcttttactggaggaatccgtggcagtacagccaagagagaaattatgaaacagccctaatctgtgaagactggatacagaagtttggacgctgtccatctattccaagccaccattttggatccagctcagattctgggttcttggaaaaatagtgctgttggcacacacctctattctttcccttatcctgtgaccattttatgcagcttcctgtaggatttctcacagggtgttgaaaatgctgaaagtgattataaaaaaaatggacaatggagttcttgatggataagggagaaagggaagttgtgagggagcaagctggttcatagattcaaatggagatgttaatagattggaggtctttgtgtcattaaagaacatttatattagagcaatttgagcaggtgaactagaaagataggaaatcatgattgtgagggggtgttctgtagggttttgacgatgaaccttttgatatgtgctacttggaaataaccattttttaaatgagttgcaacattttgaatcagcatgtccagagatttaattttctatgtgattcaaaaaatgatgtaagagtcagaaaaatgattttctttcattttattttctatttactaatctgctattggttttacaacagggcagaagagacaactatccatttaatctaagtttagagattggcagaaaagtccctctgttttattgagaaaggcaggaatcatacactttggggtcctaaagattctaagcaggtctctgttaaaattgcatgcaggtcactggggagctaacccctcaactgctgatttgctatgtgagtgatgtacagcaggctggggaggggaaccaaagcaaggtgctcaaactacagcaatgcaaagcagttgggagacataggcagcctttatctcccagctgtttttcttgaagatgattagaaaagcatagaaaaaagtcagagggtgtacaaaatttagcgttatttaaagtccagtgggaacagcactttgttctattccaaaacaaattataatagagagagagagatcttgtccttcccacaccccatcaaactacactttatgcagctagaccattagtgttatgataccattagcactttgagaattctgttctctgactgaaaaagaaaaagcacattgtttatggaagggtctgtaaaaggaaattgcgggctagttttcaaccctgtgattcagcctcatatatttactatctacccgaaatctttgccggcaacatgccattctatccccgtctgtctgctacgaggctatcatttagaaaacattaactgaatgcctcctgtgtgctaagtgctaggaatgaataatcaggttccagttcaacacattcacacacacacacacacacacacacacaagaattgatgtgaaattacgttttctgtgcttatttatttttggtgcatgcacaaaaatgtactttttaaatgaaagaagcctctcggtgccgtgaaagagctttacctttggacaaagttagaatggatgctaagatcactttggctttgctttccaagtctctgtcctctgctagcttttttagttttattcatgggtggtatgatattcctggccttataaggggtataagtaaaatatcatacttgccttttatgttatcagaaattgggctgcacacaggaaccgtcagtgtctgaaaggaaatcacatggtcctagttgataaaaggcagaacatccaaaatataccacccgtgtcctgcttctctccccttgttcctttctctctgatttcatagagaatgtgtccaagggggaaatgagttttctgtagataaatcagttggccagtccacagtattgagcttccagtggacaggtctgagaaatggggaaaaatacaaagaggttgagatgacagtaagtaggaaaggtaaaagcattttgcatgtagaagaaaaatcatttggggtgtgcacttgctttatttctgggttttagtttgtgatcagaaaactagcagaagctgatgaaaataggaaagcatttcttttctcctattgtgttctttaaaaaatatatttcgccaaacagatattttataaaatctggcttccttccccatagataaattcctttgaaaggagtctgtaggtttaaaggttgcttcagaatacatttaaaattaatctttaaaattaaaggcattagtgaattttaaaattccattgaatatatgtttatgtgtaaagatgtttgaatactttttcttagggaaaaaagggattttaaaaaagaaatattagcacttagaatttaaaccagcttttaaatgatacatcctatatataaattttagcatcatttttcaatatttttaaaatgcaatgaagatctcaatggcaggtgaaaaatgatatctgcaagtgattttttaaatgggagcttattcaattttgtaattatagctgtatgtgaagaacaaacaaaatacatgtgcaaaatataataacagcaatatctgcctggtatttctaaaggactttggttacatataattcttgtacgcatgataagaaaaggaatgttaatttttaactcaacaaatacagcgttcctataaggtggtctgtacagtatattggtttgtataattcacacattaagtgaaaggaaagaaagagatgaggagtggaaacacttatctcatactcttgtctagttgaatattgttttttccatctttgacatttgaattttgtagtacagtgcagtatgaggtgtttaaagcctataaactgttatttaactaatactgttttctaaaatactttccatgatctaagaaaataatttctagtttcttgggctatgtattaactgggcattctaaaacgtcacttctcatcactcccatgatagtacaatttcctgcttccctcctaaatcgctagtgctccaccagtctcctttgccagctcccttcctttgcctgctccttcttctttggccaccaatgtttccggtttcaggaagtggaaccatattctggccaggtttccagccaagagtcttgacatttgtagcagacattgcagggatcctaccaaatctccttggcacttattttcatacacatgaacttaaggcctctgtctgatgcaagtttttgcctgcaggctttctctggccactggagctcctcttggctcaaacccaggcaggtgagcagtgcgggtggggctaatgccccccgaaaagcagccatgagtctgtgactaacatgatttgatggataagtaacccatcttcctcatctcttaggatagctaaagtgtgttccacactgtctcccagatttccccacagttgcccacagtggtaaccacttaactgtctccatgccccttctggatctggtgttcctcacgtggaccactgtagttcccagagtctgctcatttgtgtcccatcattcggtctagcccttctccagtccattctgtttttctattatggtaaaatatacctaatgtacaatttactgtattaactgttttaggtgtacagtttagtggcattaagtacattcacattgttgcacaactatcaccaccatccatctccagaaccgttgcatcttctcaaacagaaactctgtacgcattaagcaataactccccattcccttcttccccagcccctggcaaccatcattctactttctgtctctatgcatttgactgctctcagttcttatatgagtggaatcatacagaatgtgtccttttgtgtccggcttatttcacttagcataatatcctcaaggttcatccttctagttcattcttacaataaaggaagtacaacttgtgaattgggaaaaagcagattggatattttttagtcacaaaacatatttattgtcagaagtgaagcaaacaaagttgttcaaagacaaagctaaatatttgtcgaacttcacctcattcctgccctcctgaggtgacctgtgttaacagcctggtgtatttcctttcacacgtttctcctggaagggcaatttttctaaaatgtaaatctcatgagatttactcttctgcttcagatctttccatggccctccattacccccaggataaagtctgaaatgatggttatggcccagaaacactgcagacctgaacttggcctacttcggatgccttgtttcccgtggctcttcctagggcctgtagctacactgatccactttgaagttctcgaataatctgcaacctctggcctttgtacctgcttctgtcacgtgtagtcttcctagttctcctccctcccacccctgacctaggtaacttttgatcattcttccaaatatattttaaaattcacttttaggggtccttcctcttgtctgacagacctgtgtgaactaccttagcgcctgcagccagaaaaaaaaaaaaaaaagcttttgggcaaagagtcagtcactgtagttcaaataaacaatggttgttcgtagaagtgaatgaggagggaatatgggtataacatcgacaatacctgctacaacatttttcatgaaaacctctgaatcacttgaaaaagtaatgacaataatcaatcttattgagttctaaaattttatcttcataagatttttaaataatagctttgttgagatattattcacatacaattcacccatttcaaatgtacaattcagtggattttcatagattcacagggtcttatgatcatcaccccaatgtaatttttgaacatttttgtttccctaaaagaaaactccacatcccttagcagtcattcctcattccccatcaccaccgtcagtccctcagctccttacaaccattaatctactttctgtctctagatgtttgccaattatgaacattttatacaaatagaatcaaacactgtgtgaccttctgtgtctggcttctttcatttagcatcatgtcttcaagattcatccatgtggtagcatgtatcaatatttcattcctttttaaggccaaataatattctataatatgggtgtgccataatttgtttatcttttaattagttgatggacatttgggttgtttccactttttggttattatgaatagtgctgctatgaacattcttgtacaagtttttgtgtggagatatttttatttctcttcggtatatacccgggagcgaaactgctagatcataaggtaactctttgtttaaccttttgaggatcaccctcttaagattttaaagtacgatctgcagtgatttactgaatgtcacatagtgcaggtacacctacaaagccatcattttgtgctgcctcctggatagagggtagagatgcctggattactgggttgcctgtgtctctcatatgcttttctgagatggttggtgctgggagagatcctttgggaaaaactcttagcctgttcagcttctttaggtaagatgctgtcctgaggctgacccagttctgtctagttctgacccagttccaaacattaagtagagcatccatgtaccatgccaagccatacccttcccgtcctttaaaagctgactctgggccatcttgagtgttgaaatcaaacctaaacctcctctatgtagttaatcccaaagcccaaataagatatcatattggcaggaataaatccactcatcaaagtttatccatccattgtttgaggtgattgtttcctggattgtaggtattcctggaaaataatgtgaaacaaggtaagcttccaggaatgaaatgcaaactaaatggaaattaagacacattcataaatgtgtctcacaagaccaatgaagctaaaacatttatcactaagaaaatgattatccaaaacaattatcctaaacagtaagcatttggtaagtaatatcatatatacgtatacagataatgtatgtatgtattgtatatatatttatatgtttataaaataaacaaaatgcttcacatgaaaactccaactagagaaaatacgtatatatttaatgtgtgcatatatgaaatgcgtttacttacatgaatatatttatatatacatatattttgacattatgtttaacatgtagtaagtattctccttagcctagagttacagatagtgatgccaagttcagtcccttaattgatgaacaataattatgttgtattcatcagtttaaaaagcataatataaacaatgttattaaattccaagatttacactgtaatctaatagagatgtattggtggtgttaaaacagcaattaaaagaaatagctccctagccttgaaaaaataatatgcatctttctctccatctcccaatctgatcattagcttgtaattgaagtaaatttcataaaataccaagtagttgactttgggatggcatttctatcaatttacttgtatccattatttttctgaaatagagaaggttagtagcaatatcaaggaaggtggactgtgatttatagagaagtttgcaattatgtgactaagtgcttaatttagggatctcaaaagtataaatttacaaagaaagttgatcagttgtgaagataattcaggaaatagtccagtaaatgaaattgcccatgtagtatcatgactaaataggggttttttgactaattctgggtgaattataattatttttataagttcattttaaagacctaccatttaaagacaaccactcttaactttgggtatatattttttccagcctcttgaaaatatattcatttattttggctatgtgtgtgtgcgcacacgtgtaccacacatttatatttgctgtcatagtatagacacgattttttatcttttcacctgattttctattataagcattttccatattattacagtctttatgaacataatttaagtaacgtcaaataaggcataccaaaacctacttaactaataccagactattggacgttatgtattatgtgtgtgtgttgttattataaatgacagtgcactaaagatattcagaaataattactttttcccatatttggtattcttccttaggattgactcataaggtaataattcctgattttaaaatatggacagtttaatgtttttgacagatactgccaaattgtttttctcaagtactttaccaattactcttccagccagctttgttttatcacactgttgggatcacttaatagcatcctttgctttatcaatctttttcaaattgagagtgaatgtggtattctaacttgggaggtgaaaaatggttatttttcatttttaattgctggcaaagtcaaatatttttcttgtgtctcttattcaattatattttctggggaggttatttttatttcatttttttgacttgtggttagaatatggggtggaatccattcttctttctgaatgaaccagtatttgtttatgtttctgaactgggtaggtaactcataaaagaaatgttttagccaagctgttgagttgcattctctgcctttaagagcctttatgcccttccggtgcatgtattcagtgagtgtcccaactacttccagtgtacagatttcacacccaggtgtatggccaatagccacagggtgagtcctgatactgcaattaaagtggcctaatccaataagtagacttccttgaacatattttctgtgtggtattagtgtatgtaaaatttgtgatgtaattctactgctttcacaagcctttagtgaaactcagtggattcaaaactcacttttcctaagatgactcccaaatctctatattttcagctgagttaacaaatgtgaaaataaataaatgtttattggctttgaatttgggtcagttaagagagacaaggaattggggaagcatgagataacagagggacatagtaagacatagcactaagaatttacatggagaaccccacaaaaatacaatacagggtaaaggaaataaagactcatagaatcaaacacaaatccagagggacaaagaagcacagaagaacataatatcattgcataattttctgggtttagaattttgtcactaaagacatataaaatgttgtaattttgcaactgtgggtgtaaggggtgacattgccattttgagttggcaaaggatttacttctttgttcaggaggaatttgaaaagtagcacgggtttctcaggtctggattatacctctcttcaacatgacggaattggccgttcctgttacaggaggctttacctttcaacttgggttgctgactcatttgacaattttggaccatgcccacagcttgagagtacagagagtttgttcaaagtacttaaaaatagacacacacacacacacacacacacacacacgtttcagctggagcataatgctaaaatacatttaaaatgtaagaaatttctgtaagtagctagtacagcattgaataggtatctttcttttcaataatctaacagtgcaggcctagaatttaaataccccagaggaattaataattaacaaagcccttaaaataactctttaaaatttcaggtgcttacatgacattcagcaggggaagcattttagttttctgacaagtgcccaaaatggtgttactgatgaaaggagactgtagattttagacatgaggcagataagctatggagctaacattatgctattgatatttgggggtctgttttgaatccttgtccaggtggaaaactacccttctgcactggtactttaaattttttccttgacaaaattttgtattaaatttgtagttaaagaaacatttggaacagaaaatttgggactaaaaattttggaggataactgtgatcaaacggtcaccttgacattaaaatacgtttttgatacatcaggttttgaggaggaatgcattctgatggccgcactagcgttagttctttgcaaaatgagttgctcttcatccttctgaggtgaattaattgactcgtctgaattctttcctgccagcaacaaatatttgttgaggatggctacatgccagatattctcccgggtgctagggataaagcaggaaataacacacgcaagatctctgctttcacagagcttattgtctagttggtggaggggcagtcacataataaattaccaaatggaccaacaaaataaatacttagctacctacaaagtactgctagtgataagttaatcgatgaaaagtaaaataggatgcagtaatgaagcagagtcaggaaatacctcttccttagagagaacattcaaactgagatctgcgatcctgaacatgtaactatcagggaggtgagcattacagaatgtgggaacagttactgtaaatcccctatggtgggaacaacccttgcattttcaaggaacagaaagaaaaacaatgtggctgtagtagaatgagcaaggggtggtaggaaagacaactaagcaagagtgaggtcatatggggccctgtaaggtaagttacagggtgggactcctgtttgcaatggaagtcattagaagatttgaaatacagaagtgtaatgagttggattttgttttgaaagataccctgagatgtgtaatttgatatcttagaaaggcaagaattgaaggagttgcaggcttttgcagtagtccccaaaaaagacgatattgtcttagaccaagatggtattagtaagaatgctgagaaatggttgtattcaggtgacactgacttgctgatgtattgactggaggccagagtggtcaggaagaaaaagaatcaaggacaattcctggattttggcctgaaaaactgggtgaattgtggtaacattattgagatggaaatgactagagaggaactgatttgggaaaggaaacttaaaagctctgtttgggacatgttatatttgacatgattattacatagaggaaggcacaattaagtaggcagtttacatatcaagtctgaagtttcaaggctatggaactggttgagatcacctgtgaataattgaaaaaagaagaggctcaaaagtggagtcctgggactctccaatgtttagaggttgggaagagaagaatccagcaaaggtatttaagaagcagcaatgagttagagaagaaacccatgaaagcctgtggttcagaaacaagtgaagacagtgagtcaagagggaaggcatgaccaaatactgctaagagaacaagtcatttaaggacaaaggtgtgcccaccagatttggcaatatgaaaatcactgacatctttgacaagagcagtctcagtgaaatagtagagatgaaagtctgactggagtgagttggggaaatagagatggggaaatagatgcaatgtgtatagattattatttgaagaagtgctatgaagggattcaaagggaaagggaggtatttgaccacatattttttgaagatggaagataccagaacatgctcatgtgctcatggtaatgatccaggacagaagaagaaattgatgatgtaggagagaaaatatatgattagaggatcgaagccctgatagggatggaatctaaaaactgcatggaggattggcttccttaaagaaataacacttcatttaagtcataggaggtaaaacttcacatacaggcaaaggtgaaggtgtgtgtataggcgggttgattatggaaagatgaacaagttcttttactttctccataaaaatgaggcatgatcatcagctgaagagggatggaggtcggatggtgtcatgtaggaagtttaagaagaaaagctataaagcagccattttgtacaatggaaaattaaaaactattgctcaaaaatatgattcatttaattgtaggaaggcatctgtcaaatacggtggccttaatttcagaaaagagatgttaaagtattctttctgatgatgattaagcaaaagatactgctcagattgctccaggtttatgataaaaatgttatcgacagaaaaaaaacacctggatttgtttttgatttggggcgactgagcagatatcctaaagtgaatggggaaactagatctcagccacaggcacccctgtaataatttgcccaaccagcaataggtattttgtttttctctaaatctttgcactagtggtaatttttgtatgccaggtcttcttctgatacttgaccctgacaactgcattcagggcgtctcactgagatctatctagaatgattctttttttaagtgtaaattatctcaaagggattgaacctaatgaaggtataagtaatttcatctgagttccatttgaggccttgtcttcacaaacattgccagcttgttttggcttttgttaaatcgttttatcaaaccacgagctgcgttttggccagacatggaaaggtttcaacctatctccaatctgttggtatgaaataacaggaaaagcctctttccaaaaataatctgagtgaaaagttaaaaattatggagctccccaaagattcttgcgcatttagatgcaaactctgcctcagtctgccttctcctagcctgccatggtatcctccttcttatgggtgatctagtaagggataaagtatttactgctgtggaaaatccacactagggagtcctaacacaccctggggcctggttagggcaaattctctcgaggaggtgacacttgaactgattttgggggatgaggtggaattacatgaaatctcagcagaacgaaggcatggaaacactaaacagcgcagagtgtgagaagaaccacaatgaggggaaaggagttcagtgttgccagagtataggatgtggagcagaaggaaagaaggctagagaggttggcagagggcaggtcttgctaggtattgcagggtattatgggtaagatgggatatggaacctgaaagactgaagcatgaagcccaggatttaggtttgagctcctagcccaatgactgggcccaagtgataaggcagaaggaaacctgggaaaatgagtaggatttgatcatgtattggttcaggtttgtcaatgagccctacattgtaaatatgcttcacatacaggagggaggaatttcctcagtgggttgacagaaagccctgttggggaataggaagagcctccatctttggagccatgcaggcagctgacttgaatctgcgagggctcaggaaaatggtgtctgtctttgctgaagccacattcctattaatggaatgaggcctagatggtagcttagatcagaggttctaaattggtagcccatggaccaaatctctcacaagttggggctggctcgccagtgttttaaaatttgattttagtgtttttattcagctctccaaagcccttgctgttggctattgttttacacttgcccatctcacactttacctactattctattcagctccctgggacttttgggtttccaagtcctaacttagaatgaaaaatgaagacgaaatcttgccagaacctcaatatctctgactccgagacaagtccaggcaacgtaacttccagaagctagcactcgggaggtgggaggtggaagttgttttcagagcagcaagaaattggggaggaaattctttgcagccatattggcagggtctttcctttctcaggaaggcagaggccagggtgggatggaccgcaggactccaggaaagtgctttggggatgttagccttgctgcaagatttaattttatgtggagatgatcacagaataggtagtttgtggccaggagcagtggctcatgcctgtcatcccagcactttgggaggttgaggtgggcagatcatctgaggccgggagtttaagaccagcctgaccaacatgaagaaaccccatctctactaaaaatacaaaattagccaggcgtggtggtgcatgccggtaattccagctacttgggaggctgagacaggagaatggcttgaacccgggaggtagaggttgcggtgagctgagattgcgccattgcactccagcctgggcaacaagagcgaaactccatctctctctctctctctctctctctctctctcttcttctctctctctctctctctctctctctctctctctctctctctctctctatatatatatatatatatatatatatatatatttaaagaataggtagtttgtgttgaggggctggaggaggatttctagtcaatggtgtttgtgatgggatgctagcggtgtagaaaggccctggatccaatgcttttaccttaaatgaaaaaaaaaaaaattaaattgtagttaaatggaacaagagaaaataatgtgaaagtacagttgacccttgaacaatacaggcttgaactgctcgggtccacttacatgtggattttctctgtctctgtcacccttggggcagcaaggccagctcctcctcttcttcctcctcctcaacctactcaacatgaagacaacaatgatgaagcctttttgatgatccacttccacttaatgaatagtaaatatattttcgcttccctgtgatttccttagtaacattttcttttctctagcttactttattgtaagaatgcagtatataatacatatatcatacaaagtatgtgttaatggactgtctatgttatcagtaagactaacggtaggctaacagtaattgagttttgggagagccaaaagttatacatggatttttgactgtacaggtggttggtgtccctaacccttgtgttgttcaagcgtcaactatagatataagcagaaggtaaaatctactataattgaatttttaaaacactaggatttcagcaggttcttttatcagaattaaaatagttgaggggccaggtgtggtggctcatgcctgtaatcccagcactttgggaggccaaggcaggcggatcgccagaggtcaggagttcgagatcagcctggccaacgtggcaaaaccctgtctctactaaaaatacaaaaattagccggtcatggtggcgtgtacctgtaatcccagctactcaggaggctgaggcaggagaattgcttgaacccaggagacggagattgcagtgagctgagatggtgtcactgcactccagcctgggagacagagcaagactccatctccaaagaaaaaaaaagttgaacgctgcttaaaaaatcatgtagagttttggggttttttttgttttatatttattttttatttttgctttttcaagggcaaattcctgaatgctggggggagatgctgtttctccatggtgatggaagacatgttttgtctcttcagatttaggctgctgccagagacaccgactgtagactaaagcagggagaattagctccaaagcactgggacagaggccatctgcttgtgaaagcagcttctaagaaaacatacctgttcccctatcccttcctgctccttcccacaggtcacttgccttaatggtgtttgccaagagagccatacctttgccttttctcattgcatttgtttatctgtttcaaattctgtatgcaaggcccattctaattgagtcaataaaataaaattctctaggagtctggttgttgtgttatgacttccaagagtccttgtttttgttctctaactacagttatgtattgtaatacctttatgttgtctctctattttagcaggaagggtgccactcaatccccagtgacagatgaagaagcagttgtagcttctgcattgctgtttcaatgatacctttagctctggataatgcccctggttatgtatgttgctcacagcttcagtgcacatacacacatacacacacacacacacacacacacgtatatgctagacactgagcatgagtctgtgccctcctatgtgggtcaaagtctatacactgttaggatgggactgtacagttttaatatgagtctttcgggttaggctttaagaaaagaagaagaatctgcttggcttgtgattattgaagccaatgtttttaatgccagaactgattcttctaccacttgtgacttctgtttgaaagttgctattaaggtcttaaggaaaggattttcccacacacatgtttctgaataacctattctggtcaagttcacagtcttgacctgccaccatgtttcatcctacctggtctgggtgcccagagacctggagcatctgagctggcaggatggaacttcttgtgcctgggcgtgccaaaacttttccttgacactgagaaagacaatgaggctctgaagccagaaaatgtctcggtgagttgaatagttacataaatgtcattgacaatcattgaattttaaagtagagttgtacacttcaaaaatgctacagaatttgtatgaagcataggacttgtataatcttggcaatggctgattttttgatgcgaagttcaggaagctttatttctcacttaagttctagattattcacatcccctcattattatttactgctctgtgttgaatggagaaaggcctctcctttattgtgttgcttacagctccaaagctggaacttagatttcattttattttactttaagttctgggatgcatgtgcagaacatgcaggtttgttacataggtatacatatgccatggtggcttgctgcacctatcaacctgtcatctaggttttaagccctgcatgcgttagatatttgtcctgaagctctccctcccatttcccccacccccttacaggccccggtgtgtgatgtttccctccctgtgtccatgtgttctcattgttcaactcccacttatgaataagaacatgtggtgtttgtttttctgttcctgtgttagtttgctgagaatgatggcttccagcttcatccacgttcctgcaaaggacattaactcattgtttttatggctgcacagtattccatggtgtatatgtgccacatgttctttatccaatctatcagtgatgggcatttgggttagaactgagattattaagctttgtcactatgaggctcacccaactgcttacttaacatctgtttgggctaatgccccatttcccagttccaacaggtcactcgaaatagtgcttctgctaggaactccctctctgctctcttaccctctcccaacttctcagcactactgacaacataagaaaaaccattctggagtggctacccagggttttcatcaccatgttatccccaaataagcccaaataagtttaattaacaatgaagttagttagtacagaagataacatttcccatgtatattagttggctagggctgctgtgacaaaattccacaccctgggtggcttatgacaacagaaatgtattgtcatatggttctggaggctggaagcccaagatcaaagtgtttgcagagttggttccttctagggatgtgagggagaatctgtgccatgcctctcccttagtgtctggtggtttgctggcgatctttagtgcctcttggcttatagaggcatcactctatctctgccttcattttttcatggagttctccctatgtgcatgtctctgtttccaaatttcctccttttacaaggacaccagtgaggttggtctagggcccacaatactgacctcattttaacttgattacctctgtaaagactatctccatataaggtcacattctgaggtcctagggggttggaacttcaacatatgaattttgaggcatactcaattcatttcacaacaccatgctacccaaatttactcatctggccatcttccagctcctcagaggtggcagcacactttcccttcctccttgctctagctgagggcattgcccccgggcctatctttggtgtaccttttcctgggtgatcctgccagactgcatggccagaaaaaaaacaggggaactttccctgtccttttccttctcatttcatcgttttcttttcttttttttttttttttttttttgagacggactctcgctctgtcgcccaggctggagtgcagtggtgcgatctcggctcattgcaacctccgcctcccgggttcacgccattctcctgcctcagcctcccgagcagctgggaccacaggcacttgccaccacgcctggctaattttttgtatttttagtagagatggggtttcacatcgtgatccgcccgcctcggcctcctaaagtgctggggttacaggcgtgagccaccgcgcctggcccatcattttctacttttctgtaacttggctgtaccaaatgcacttctgacctccccaggaagctccctttccaaatatctgtagttaacctcttccttgccttcatggtgcctcttctgttaggctttgttcttttctagaggcacatcatgttttggatatcactctaaggaacccaccaccagttttagccacattgaccaaattgaccagttgctttaggtatgtttttgaaaaaatataaggagaactttccgccctcaagagaatcacttttgtcccctgttgcccaataagttattaaagactaagaaattatataaatggtatatagtatctttatggaattatgtgatacattaacttggggctctgaacaagtccagcggaatagaaaccagtttaacttttttccagaattctcttactatgaaatttttcaaagaattatacagtcaacactcatataccaaccaactagactccacaattaatgtttttgctatatttgctttattccagtatatccaactatttatccctctctccatctatcaatctctcttgatttttgatgcatttcaaagtaagttacagacatcatgacatttcatccctaattatcttagcacatctattcctaaacagctttgtttaaatcagcatttccttatcgtatatgaacacaaataaaacacatatttttattcacatctattggtgacacccaaattttaagctccacagggcagactttgggctagatgctttggggtcataaagatactacctctgtaatgaaatctcagtttatgtgacattgccaccctgtctcatttgggttgatcacagactgaaaggggcctaatttaatcaccttattttatagatggggaaagtgagtcccagaaaggtggggactcttgtctgaggttatgcagccaggaggtggccttttgggcataaagctttttctactgaagggcaaagacctggcttcttcttgaccaggtggtgttttcatttggttctggtccttgcacactgctgactaccttagtctttgtttcacaggttcttgttggggcagactcactaggctcctagaagatggaagcagggccaggctttggcatcactgaatgactcctttgtaattttatttcttccaatcactgattacatcacactcagacttcttttccttggcacctcccacatgttgtcctctttttctagatttcctaatctgtcttctcctttctggtgaaaggggatgttttcctggagacgtagtcagcatactctatagcagacttctaaccctcttcataacatttgtaacacccatcacaaaatgggatctggggagggggtcacccaaagcagaaatggtagctcttcagttttatattcttccttaaagatgcttgtgattctaaaaattgtgttggtaatccgtaggagggctactatcatagtagtgaaatatttcatcctcagatccccatcaaagaaatgatcatggtattttagaataactgagggagtacaattgcttaaggaaatggataccccatttacctcaatgtgattattacacattgtatgcctgtgtcagaatatttcatgtgccccataagtacatccacctactatgtacccataaaaattaaaaataaaaaaggaaatgatcatggcatcatataattatcttctatacttaaaaaaaaatttcttgagagtatgtttatgcatacacacttcctctaattcccagaaggatttgaggcaggtaaattaaaagtttaattttatttaacagtttttataatgaataatatagcacacaaacccgagaaagacaaagctataatttctgggtttgattcctttattcatgggagactatgttgagataaagcaaaaacaaattttgtcttccacgattacaatacataaaagatagtcaactcctttcaaacaacaaagggtagagacaaaagcttggttattaaacaagactcattatgattgctgacattttagaaaatgcaatcatttgcatataaactgtgatgaagagacaatttttatggttttagacatattctgaaagaccttggaaggcaatctcattctagtatctcaaagcggctgcatctggagaaaggtttctatggcaacttatgaaagcttgatgttttttatctttttcaagagcataaatcatcccacagcctgaggcttcagtaaaggtctccattattttacaagctattgccatttgttttcatgttatatattttgattgtcttagaggaaagagagcaaaggttatcatgtttccgagaaggcttggagtctattttctctttttttcattttgtgggacaagacatgaataacatcattctaaacattgcttctcaatgatcaaaatgatggtacacattgcaatatttggtttatgtcacgtgttgtttagattttccccaaaattgtgactggtgcattctcaggaagacaagccagtttgaacttaaggaggaggaactatttggccaaaacacctcctaatatgtagttcagtagagatgccctggagaatgctgcactgttccacatgcctgcaaatattcctctaatgatacagtcccaaggctttggacattgatagactccaggtgatttttatcaacatattctttccaagaaagttaatttaaaaattctgattttaaaactctgcatgtttcaagaattttgttttagcaacatggatctctgtatgttataggaggtaataaggctgaggcaacacccattaagacaaagaaacagaaccaggtttcagacctagctctgccattgctaggtgtataactgtgagcaaacccttgaatctcttcgaacctccttttactaatccgaaaaataggagtaacggtgccagattcatggcattattgttaaggattgaatgcgtgtgagtgctgggaactgtgcaatgctgtacaaatgtaaggtggttattactgttggctgactgtctttctttccctttgaaaaagtcaaaagtttatgttaccatttctggatgaccagaggaaatcagtttcagtatgtcttaagtattttagtttcttatactgtatttaaaatacttatacagacactgatcactacagccatttatttatttatttactcagtaatcaaatgtcacccctgtagaagggtattaaataaattcattcaacaaacatttaagtgccaactgtgtactagcattgaggagacaaagaatagacaattaaattcttattgttcaggaaataaaagttttctgagcttcaaggccacagcataagctgttcaggtggtgccctgcccaagggcattcggctgatgaagtagaagggggatgtaatgcagtcccccactctgccagccaagccgtttgcatgcaccttgtgagctgcattcgcctgaatgaaggacatgttttggaaatttactagccaggagtgtgtgccttcttgcaatttacacgaaggcatgcatgaatgtgctagcagtggccctgatgcttgtatgatccgtgatgttaaagggaagatttgcaatgtttcactgtgaaatatgatgaaggctgctggcgtgcttgttatctggagtcagattgcctgaatttgaatactggctctgctacttgctagctgtgtgacctttgtgcacattacttggcctctctatgcttcattttctacatctgcctgcctcatagttattgggaggataaataagttcttaaaacacatagaatagcagctggcacacggtcaatgctcaaaatgttagctgttttcagtgatggctttactgttcagggtctccttgctactctgtgttgaaaagttcaacaattaacatctaaattctacctacaaaaaccacttttcttttatgaatttgatgtcaaattggtgatatttatctccttacctcagatctttttggtgtgtgtttgtgttaaataactagaaagtattctcttcagagaaatcagagaattccagttatttgatgagaagatgacttggtagtttttagaattttctcataaaaccactgctttgtcagagtgatagaggtgatgagggatgtttgcatattattggcttttataatcccagcactttgggaggccgaggcaggcagatcacctgaggtcaggtgttcgagaccaggctggccaacatggtgaaaccccatctctacaaaaagtacaaaacttagccgggcgtagtggtgcttgcgtgtaatcccagctacttggggaggctgaggcaggagaatcacttgaactcaggaggcagaggttgcagtgagccaagattgcgccactgcactccagcctgggtgacagagtgagacttcgtctcaacaaaacaaaacaaaactaaaacaaacaaacaaaaatgacaacaacaacataaaaaaaaaaacagtcccaagggaatgcctatatagtttaccaggattacaatagggattctttgaggtatagtgaatttcattgtcaattttggttaacatgattccctctctctcttttcataactttaaactgggaaagagtccttatgtagtattttcaagactattaactttgcattttaattttttaaaaaagttttgttaaatatcaaattttgatatgaagagtgtgaaacagattgacaaagccaagcatgaggcaggtggtgattttgattttacccctccctttgtattctggctcctctaactgcccttaagacactgtaaagagggcacttctgtgttactgccactgtgtatttcccagtctcccacagcatctaacttgggccattttcttggcaaaaaactaaaagtgcagaatgctaatcatgttgtacatcactgatttctaagtatttaaaaaatttgggtgtctactcgtaattgagattgtcatcacttttatgaaaccttttccaagtaaacttctcagaagagagatgcaatatttttataatttcataacatcaaatattagtctaccattatttgtgtgtgctgtgctatgattattcatccaagggcctgtcatggggacatagggactgcttctgaaagtgccaaattaccatttggttgtgagattataattgatactgcatgttaaattcaagtgtcattagctttttaaaaagatgaagtgatgataagcttgctcctaaattgtttgcaaaggttaaatatctaagagaaaagctggtatttaagattcttatatttagtcagatagtagaatgttttaagacactttatatcaatcagtgtatatgtagagttactgtgtttttaattttttgttttttgtccaagggtagtggctaagagttcaggttttgggttgaactctgactctgccacttactaattgcgtaacctacagttaagtcactgaatgtctctaagctgccattttttctttttaaaatgaggataataatattcctcagcattgtggtaaggatcagttgagctttttgtgtaaagcgcttcacccagaccaaagtgcttcatgagttatgatggtggctgttattactctgggcattttattttattttatttttttaagacagagtctcactctgtcacccaggctggagtgcagtggcatggtcttggctcactgcaacctccgcctcccagattcaagtaattctccctgcctcagcctaccgagtagttgggattacaggtgcccgccaccacacccgggtaattttcgtatttttagtagagacggggtttccccatgttggccaggctggtcttgaactcctgacctcaggtgatctgcctgcctcggcttcccaaagtgctgggattacaggcgtaagccaccgtgcctggccagtattttcatttttaacaaacaaattgttaattgcattatatcaggagattattgcataagtgtttaaacagtggcgattacattgtctaatgttttaaggcaaatgtatttctgctactgtatgatttttttttgcaatagtattgcactcaaaaattttcatacttcccagaggatataccatctctcatatttttgtttctatggcaaaatgtattaaaagttccaaacaaccaacatagaaaagaactcttgggaaataactgtctttaggtgagggatgctctgtagagttcattgtttgcttagtccttgagcagtcaaactattagtccttttatcagtcatcattgagggaggtttttgagctacctcttctagacaatcttaatcacctcttgaccagactccaactcagtttcctatgtaccctaaaattccctccttctaaattgcagtgacttccctaagccactgatatttggaccaatttttttttcagatcaatttctgtcaattgatttccaacaagcctcttgactaccccctatgaacattagtgagctaaattgtaagttacttccagcaacatatttttgtgttgccctttttaaagatatttttgtaattttctgtttataattgtttaaggtacatgagcatagagaactccgttcaatgatttgataagtcttttgtttgttttaataactgtttatatttaacatcagatattattgggtaaatgcatttactaaaagacggtaccttttgtggaatataaaatgctagtgtatacaagtaacgatgtatttccttctgaactcttttgtttaagcctcagcatgctcaagcggtttatctaaattcagtgataatagctgttactatggctgcatgttatttcatttgttgaattgatgcttggtaagaaaaatgtcattgaattgtttgcaattttgaatttaaatagaagtggttctttttccttatggaggtaaaattaggaaactggggttataaatcctgtgccctgtattcctaaatcagggttgtgcaatgcttgtgtgcactgcatggggttcatggactttggaactgttatcccatcagcaactggaagcattggctctgcccccggtgacagggatgggaagatggattaactcaaataatgaaatgtcaaatcagcctctctataaaatgggaattcctcctttaagatcactgatagacggtgactaaagccttggcttttcattatggtttttaatgtgggctcatattttatgttatatggattcttataaaccacaacatataagtgtgtcttaaaaacaagctgatccaaaaaagtgagaaatatcttttgaagtgtaatttctctttgtagcaaaaattggaagatgcaatcaatgaagaggatggccatgggggtccggggaagacagtgttgtataatggctgtgaatacagatgctgcagttaaactggctttgtcacctactccttatgcgaccttggtcatctctttgggcttcgattttctcggccataaaatgggaatgtcaacagtacttatctcatggggtcgtagaagttcattgaattaatttattaaaacacttagaacccagtataataagagtattagctattttataggaatctttttaattttgcagtagtggtgtctaaaagtcacagaactattatttttgaaagacaagatagaagcggttttatttacgttgtaaggcatgagagcatcttggcatggccttaatatttggtctcataaagcaaatgaggaaggtaattggaactgagcacattcagcccactcatcatgggaagagcaccagatttctgttctctgagaaagcttgctaaattctgtaagagtgcttttaaaaaaaaatacagtattttaagagctttgaggtcaaaaactacatccaggatggattagtaccccaaactttatacatgtactccacactatgctttgtcctttgtcaaaatgtattgaactctgcattaatggatgtatcagtcagggttctccagaaagacagaaccagtaggatacatagaagaatacatttactgggggaattggctcccaccatcacacagatagaggagccccatgataggctgactgtgagctggagcatcagagaagctggcttagtctggaagcctcagaaccagggaagctaatggtgcagctcccagtccgaggccaaaagcccgagagcccaccggaggtcactggtgcaagtcccagagtccaaaacctggagtctgatgtccaaaggcaggaggagaacaagcatcccgctccagaagagagagtgagggcagagacagagagagtcccctcttctttcacctgtttgcccctgcagggccccagccgattggattggatggtgcccactacattgagagccggttttcctctcccagtctgccaactcccatgccagtttcttctggaaacaccctcacagggacacccagaaacaatgcttcacctgccatctaggtatcccaccatccagtcaagttgacacctaaaattaaccatcacaatgggtaaagtttattgcatgtacatttacctcagtaaagctgtgggtttttttaagagctaaattcatggtggtgagaatgtaataggcattcactaagtatttttgactaaattaataattaaattagtcatgaatggaattatttcattcttcagtgatgggtcatatcaggaaatccagatgcataaggggtcgaattttacctccttgattttgaaactttacgtcaacttctaaaagtccaactttaatagtaaatcccagttcctggcacacactttgaaggcccactgtccctcagtttaccagtttttcatatttaccctgagaatgaagtcagtgactggacttagtcctgtgtctgcaactcatatatttctcttgagcatggccttgtgttctcatttatgttatcagacatgcaatttagtcattaaaatagacattttgatatagtggcagaggatgtgtttaagatttgagaaatttactaaaaaatgaaatcccttttgtcgtttccagaaacatcagactctgggcctctattgacaaaccgtatccacttgtaagttgaatgtaacaataggcggtgcacgtgagccagcatggacttttctcattggctgttagcatgaggagcttgtctggcatccttgtatttgatcctgatgtcttactgtcttttctcccaggtatggcagcagccaaacttctgcatgactctggactgaatgtggttgttctggaagcccgggaccgtgtgggaggcaggacttacactcttagggtaaggcattaagaatccggaggacaaatgtgggactgaagctgagtttggggtttcatttttgtctttttccccaaaagtcttcaatttcatttgactctaagagggtgaaaataactctgaaacattcttcacagcctctctcccagtttgccttcctttcaattcttctgttcctttttgtcttttcatctcatgatatttggcctcatagagttaggattgagtaagagggaaatggacagatatgtgtgtgcctctgtgtgtgtgtgtgtgtgtgtgtgtgtgtgtgtgtgtgtgtgtgtgtgtgtgagacagagagagaaataggaagaaaaataacataattatatgtactttccactcctaacttcgatgcttccttcacaccaacacaatcattctaatcatacaaactaaacttttttggagagactttctcccatttttaaatttattttttaaattttattttaacaaatcataattgtattacatttatggagtataatgtgatgttttcaccatatgtatacaatgtggagtgattaaatcaagctaaattaacatattcagcacctcactttcttgacattttttgtggtgatacatttgaaatttactctgttattttgaaatgcacaatacattattattactacagttactgtgcaatggatttcaaaacttattcttcctgtctagctaaaattttgtacccttcctgtctagctaaaattttgtactcctcattccctcagttctcaccccccagcccctgataatattcattttgctctctacttctatgaattcaacgtgttttagattccacttataagtctttctgtgcctggcttatttcacttagcataatgtcctccaaattcatctatgttgtcccaaatgacatttctttatttttaaaggctgaatagtatttcattgtgtgtatataccaagtcttcctcatccatttatccactgatggacacttagggtgatttcatatcatggctactgtagataatgctgcaatgaacatgggtgtgcagatatctctttgacatattgacttcaattcttttggatatattcccaaaaatgggattgctgaattatgcggtagttctatttttagttttccatttttagttttctgaggaacctccatactgttttctgtaatagctgtactgatttacattcccaccaatagtgtacaagggttcccttttctcttcatccttgacaacactgattatttttcctctttttgataaaagccattttaacaggtgtgaggtgatatctcattttggttttaatttggatttccctaatgattagtggtgctgaactttttccatgaacctgttggccatttgcatgtcttcttttgagaagtgtctgttcagttcctttgcccattctttaaaaatctggttatttgtctcttgctattgagttgtttgagtttcttatataatttggatattaacctcttatcagatgtacggcttgcaaatatgtaaagaaaactatcattttattaattgttcttttgctgtgcaggagctttgtagtttgatgcaattccatttgtctgtttttgctttttttcctgatctttcagggccatatccaaaaaatcatttccctgactagtgtcatggagctttccccttgttttcttcaagtaattttgccgtttcaggtctcgtgtttaagtctttaatctatttagagttgattatttgtatatggtgtttgcatatggtataagataagggactacttttattcttctgcatgtggatagtccgtttttcctgcaccatttattgaatagactgtcctttccccattgtgtgttcttggaatcttcatcaaaactcaattgattgtaaatgtgtgggtttatttttgagctttctatcctgttctattggttggtgagtctgtttttatgtcagtaccatactgttttgattaaaattgcttcataatatattttgaagttgggtagtataacgccttcacctttgttctttttgtacaagattgttttggctagttgtagtcttctgtagttccatatgaatttaaggattgttttttctgtttctgtgaaaaataacattggcattttgatggggattgcactgaatctatggatcactttgggtagtatggacattttacattattaattctcccaatccatgaacatggatgtgtttttatttattcacataaactaaacttttacctgcctaattttccttcttgtttttgcttcagcttttatttttttaaaagaattatttaccaatttataaatacccttattttaattgctggttaattgtttcaattctgacactgttgcctaaaattaatgattttctatttaaacacagagtcaagcaaagcaagtttctctgcaaggaaatgccctacttccatacattcaagatctgaataatagatatagaagctacagagtattttcatttccagagagataagacatataaaattctgactcacagctcttcttttggaaggattcatcaatgatatatatctgacattttgtactcattcttttttttaaattatactttaagttctgggatacatgtgcaggggtgggatctgctgagctagatcacttggctccctggcttcagccccctttccaggggagtgaacggttctgtcccactggtgttccaggcaccacttggatatgaaaaaaaaaaaaaaaaaactcctgcagctagctcggtgtctgcccaaatggccgcccagttttgtgcttgaaacccagggccctggtggcataggaccgagggaatctcctggtctgcgggttgtgaagaccatgagaaaagcaaagtatctgggccagaatgcactgttcctcatggcacagtccctcacagcttcccttggctagggaagggagttccctaaccccttgcacttcccaggtaaggcgacaccccaccctgcttaggctcatcctctatgggctgcactcacagtctaaccagtcccagtgagatgaactgggtacctcagttggaaacgcagaaatcacctgccttctgtgttgatctcactgggaactgcagactggagctgttcctattcgaccatcttgccagccctctgtactcattctttactttgagtcatctcctttataattgaatttgtcctcagcaaatatctactgagtacctactatgaatcaggcacagtaatccccccaaaatggccttgctccacagactttacagtctctcagggggacaatgactgttgtaattgcctaattatagcttatcaaggaaaatgctacagtgagggtgggtgacagcttggagtggtgccataggaggcataagagggtaccttaccagtcttgagagccagagactcagagaagcctgaaagccttatctgttattgactgtgacatacaccgcctgacctagttatttgtgatttcacacaagccttcaaacttgatctaacccttgttgtctactggccattgtttttgccattatgtgttcctcaaatatctctttttacctttgtcgtatggcaaaatcttcacatacttccaggatctcatcccttcctactccaatcaaaagctacttgcctttcttctgtgttaataccacttacctgttccacacaaggacaattattatatgttgctttacaaggttttgcctgtgtacatcttatctctcccagttcttgaaatcttcatattccttgaaaaatacagcatataagagtgccttttacgtaaagaagctggtttagtacaattaggtgctgaatttttaaaaacatccttctttcatttatttgagaaaatttattggacaactgctataggagtttggaatactttagtgagtaaaacaaagatgccttgtgaaaattgcatttttgaagggtaagtgagtggaaagctagacaaaaaatacgcaaataaacaaaaacagaagagaaggaccatttctagtgtttctaactggtaggaacctggtttttcttagacatactcagaaataggaaacttttctactaattttttgttcaaagttcgcccctcagtcattggaaatgaaaccaattcaaaactacgtaaatatactattaaacataaaagcaatttcaaagtccaaattatgaccaaatattccctagtgctattttcaaatgtctggattaacaaatcacataagaagtgatcgttttctttcttgctttttctctagcattaggctcctcaacattcacctgaagtactgagtaaagagattcgtcaataattcacagctcacaaattcaaagcactaaaaaccaagccatgttatggtatattgtaaatgatgaggtttagaagctcttgcctattcagagttcaatcaattttgctttaaagattgatttaataactaagtcatgtgaatgaagtagagttgataacaaaatctagtttttcgtggatatacccttaagctgtatctataacttgtgaaatgtcgatttgcttatttcaggactgtcttttgttattttatacattttttacaaattttttttaattttttcctatgggaaaacagaaccaaaaggttaaatatgtggaccttggaggatcctatgttggaccaacccagaatcgtatcttgagattagccaaggagctaggattggagacctacaaagtgaatgaggttgagcgtctgatccaccatgtaaaggtaagatcaggccagactttgaaggatttgaaaacttctctatgatgtttccttacacaaattccagatcattctctcagagaatcttctatatctctggatgatgcaaatgtattttataatggtatttcagccactctgagattcattcactgttatcaaaggtgaattaggtgggaattctacctatttaggaaggttattgatgaagtggtatcttccatgtggtaaaatgtttaacaaaacccataaagaaaaaacatttgtgctttatttattaaatatctatttaaataccgggaagtcttttatgttatataaaaacctgtgcaaagtttttaaaatgctgccctagactgcacattgtaaagagtatttgcaatatgcctaatggaatattcttacattttatcattgtggcctatatatcagctaaagttattcttctttggagattgacatcaaagtggttcaagtcccagatcccgtcttttgcaaggaagcttcattgttctccccaagatttctgtgaatttactgagtttctcattcctgtgatcatttgtggctcatagttctggcttccatgatacctatgttcattcacatctcacggcctgtgactcttttcttctctttgcttatgccaacctgggttcacactcacctctttgtcctgatttttctcagaccgccacaagcatatgtgaaaagcaaacgtcactgaagtttgcttgggtttggtgggcgggggaaggctcttaaatttgcagaaatacaaacagattagaactgaatgttggacattcattctaataacctcttagatcaaagcatcccctgaggatttctcactggtcacatttctctgcagattccagtctcccaccatgctgctggtcctcagactctcttcacatctccctgctcctctgtttttccagcatcctcatcttggtccacaaagtcactcatgttctctgacaatcagacagtcacctaatctgggccccatccaggagtcccatggaagaactggcggaggttttcaatttcagtctttcctctctcatcttcacttgctcctgtgggtggaagtaagcagcacaggaacttattcctcactggtagaaaacatccccttagaagacagaagaaactagcaacggtcaattttgatttatataacaattttgacatcctcatattatttgtgagtgataatatcgaaacaaataactgaccataaatcatgaaacatttaataaaatgggaactaagcagttacttaatttggtataatgtgggtaaaagttttccttaatttataaataaatgttttggttgaccttcaaattttattttatattggccgggcacagtggctcacgcctgtaatccctgcactttgggaggctgaggcgggcggatcacctgaggtcaggagttccagaccagcctggccatcatggcgaaaccccgtctctactaaaaataccaaattttattttataagcctttccaccttccttccctatgtgtctaggagaaaaagagacacatgaattagaaatgaaaatctaccatggtgataatgtgatttgttgaacatcaatcaacagttcttaacaccctttgttgggttctttgtttttttaaatgtagattttcttgaccgatttcttatgtcttattctacctgtaaggcttgcagagattgacttttcagaacactaggatctttaaatttctccagacaaaggaaatgaccagagattatattcacttgcctgtctttgtgtgtgcagagattattgtcagctcagagctatgtccaggatgctttgttttttcctgacattaagtcccttgtctgagagaaattgctgagtcatcaattacaggaatgatgttacacttaaatgatatttcacagtgatggccaaatgtgctgctttttcactatttccattactctatgtgcagttaggaaaatacaagtagttaagcagtagtccttacttaatacagggtaaatacatatgccaataatgctctttatatttaaaataagtcttactgctttttaattatgacaaaagtaaagcatgtttattgtaaaaatatgattagaaaatatagataaactagaacaattaacaaaccctttataatactatcttgagaagatcactctaaaatactctcttggttcgtagattttcgtattcctgtattgctattttctgacctctgctggaggaaatgggaaataacagtgcattttaagaaattgtatgcacatgcatatgtgtatatgttttacgtagtaacttactctcaaattaattatcactaatgagacaaattgaaaaaatactgatgctgtaaaaaaaaggtttctgcagtcttgacaaaggtgccaatttggcctcctcgtgatcagtcacatgcagtgaagagctacatgataatacataatgacgaagaccttatagctaagaagtccttctcaaactaagtacttgttctctaccatctccacttccatgtctttgtatacgtcatttttctcatttttgacctgtaaaaagcatcttggatggctacattcatttccggaattattaacaagaacttcgacattctttctcctaccacatactagagaatgtagttgagaaatttgcctcctgtgtcatggaaagcagtactttgggaatttgaacactgccctctattacctattttaataactactgtccccaagggcaaactacagttcatgtaaatagatagtatatttgggccttgtttcttttttatcagggaacatgcatgtatttcttaatctgaatcttgagagtatcaagtatgctacttgccatattgtcagatcctgctatcaaagaatctgcttttaaaattttttatgtggctgataatgggaaatagagttttatgtgcaaccttagtaacattaagctaaggaacttggatatactggttgatattgaaatgaatgaagtggagctacccagaaaaggggaagggcacagtagctcatggtggactaactacccacatgaaagagtgtgtttcctcaagagaggatgactcccaatatcaccagttctgtggtagttgtcatagaaatgttcttctgatagaggaagtgtgttcatgccagctccataataggcatctttaaacacctagtgtgctgtgatgaacaggcctctgtcttgatctgatctgtcagacatgtttgtatctactgagtggcgttcatttttaatgctctgtagatctgttatatgttgttaaagtagggttttccaaagacaacttcataaataaaagatgtgataccaaactatattgggatttaattatcagtgagaaagggatcgcttcagctcaaatctatataatttagaaggtgttttccttacttctggagtcagtgatgcagctgttagtactttacaattattgttaaacatctactgagatttttgatccgttttacaaataggcatgctaatttccactggtatagtttagaaggcagctgtttagatgtcttggaagtaacttgaaaaaattgttttcttttaaggaatatttcataattaaaaagaaaaagataaaaacaaaaacttcttaaggaatcctgctatattttgacttatgtttctttctctttcattgtgtgtttacatgtgcatgcgtgtatggttgtctttgttcttttgggctctttgaagaagttggagaaaattctaaggtttggtacaatgtaggcaaataaaatttttctgtttcagaagctttcatcagtctgaaatttgaaagtaaagtctggtaaaacacccatgaaactgctctaggtctgaaggttgaactgttaagagttttgccactataaagatgtagtgtgacttaaaattaagagtccaacttcatactgatgttcatttccaaacttcagctatctggagaagctgagcaaaaggactttttggtcttaacctacttcccagtgggcagaaacaaagcttattgtcaaagtcctttttgcattgcatatggtcaaccttcaatgctaaagatgcatgcgaatgaggattcatctctcaaatatattgtctgcttgttgctgccatagctgctattgctcaaacagcctcacagaggaggaggcatttggcacaacccctcagtcttgctgacaactctgaaatccagttgaaaatatgatacacaaaatgcacacaaaggcagagaggggaaaccatagctatctatctgcgatgccatttcagttaatctctctgtctaaatggcctctcagtactaagaaacagcaacaggattagagtagaaatattgagacataaaaaatgcaaatgataattgcatttagcaaatggaaatcgtcctgttgtgtaaggtcttggcatctcctggaaatcaacaggccagaagtatccagtcttctctaggtcctcaatattcccttcttcacacccctgtccccgatcctattaatccaggggaggctggatcaaagtccagaatacacttgcttctctcataaagacagaagtctccaggaacaggttagaccaactcttgtttttattcaggaacagttgcccattttacatgaacttcacacttaccatgttgagtttactggctctgtgagtttgccctttctgaagtgggcttaatgaaccttttctaccacttccacccacactgcatttcatttcttatttgtttgaaacaaatatgtcttattatggaagattttttcaaggaaaaatgtggagaatagtaattttctctctagtaagtgaaacacatttgtctagtgatcattctaaagcttatgctgttattctggaaaccaaagtgctcatttgtgttctttagagaatacaggcagatctttggcatgtaataatttgctgaaaattatgcctttgatggctgaatttggaacaacatttaggatatgagatgaattcattttccgcctccaaggtttccatttggaacttaaaatatggtacaatcagtaaacatattttctatgcatacacacacatatctggataaacttaacagtgactatggttgtgggtaacagttagttttaaattttgctgggagtggagggtagacaatgtatggaattaagttatgatagtgaaattcactaagggaaacagcgatatagattaaatcttgtgcaaaattttacagcttctatactatgtgatcatgtgttatggccaagtagtccaaaggagctgcaaagacagggggcccagctcaccaaaagatggtgactaataagggaaccatgtaacagattaaagagagctttggcaacttgcagtaccaagagattgacagaaagtgcaagatggcctgaaatgtgttagcctgccttaccatgtcctctgcagagcagcagcctgcagaaaggcttaggcgtggattcccaggctgcgtatcacatgtcctgggcatttctcttggcctctgcaaccaccaagaagtaataacaatggtaacattactcttatatggacatctagaaactaccaagtgttttcaatctcaaataactataagttatttagttgtgaattagaagtattatccccatttaacaggtgaggacctaaaggttaaagagattaattgcaaatgacaagatgcaatggggtcagagcatgagttgaggcttttgggtgtcaagaacacactgcaaagagctcactctctgctggttggggactactttttgtcatttctttctaagcctcagcacccacctggcccgcctttcttcttgccaaacttatactctcacatattggaaaaatcgagttcaagatcctcctttccttaagattttccacagttgagtacagttattccactagctccctccaaagccctgtatcctcctcaccttcctgattattctttataaaagtctgtttttaagtaggataaacagttttctgttacttgtacatcgagacttcataaacagttgactcttggacaatgtggaggtcaggagtgctgaccccctgtgcagtcagaaattcttatataacttgactccccgaaaactactaatagcttgctgttaattatgttggtaaacacatattttgtgttaaatgtattatatgctgtattcttacaataaagtaagctagagaaaagaaaatgttattaagaaaatcataaggaagagacaatgtttttactattcgttaagaggaggtggatcatcataaaggtcttcatcctcatcatcttcacattgagtaggcagaagtagaggaggaagaggaaaagtcggtcttcctgtcttaggggtggcagaggcagaaaaaaatccatttggaagtgaacctatgcagttcaaacctgtgttgttcaggggtcaacgttttgtgtatgtgtgcaaaaaagcaaatgtattacaagtaaatgctaacaaccactgacattctaacagtttctcttagagctttaaggttggtaagtacttggttggccttccagattatccagatgattgtacttgatgaacaagtaaagctggcgacagttttacgaatgctttatcattttttctacctgtcagtcttgtggcacctgtttgctggctacatgcagcctgtccactaagacaaaggcacacacaattggaaattttgtcatagcagcattctagttcagaatatcaccaagtgataaatcaagaattcaggaatggatcagctttagtgaaactggtgttgaacataaaatatatctaaataaagatttaaacaattggaagaattacaatcatagtaatttatgtacatgttattaaaaatgtttatatggtaaaaattatataatcaacaaaatcagaatgtagagaaggtgagaaaggaagacacataagagaggtaacagctgcttaaatctttcatagcaatgaatcaatctataccaaaattaatagttaataaatagttaataaattaattagttccctcaggaactaatatctcttagggtgtgtgaaacatctatttgaagtttagcacttccttcagttcatttcagtttatgtttcttccatcaaattgaagtatatttccatcatttaaaataacagatataatatgattcaattctcatattttttattttctctttgttcttttctccctccttcctttcttccttccttgttttttgtttccttcctccctctctcagtcatccatttgttcatttatccatccatagcaaccatccatccattcgtctattcatttttctatcttgtagatgcttatataagaggtctggaatgtcatacaccaaatgttacggctttttttttgtttaacttgatggtacaacatggagtaattcgttgctttcttctttgtactttttagtactgccaaaacattttataaagagctcctctcatttttatttttaaaaatgtaattagacacagactttactttggaaagctcatgatctatgagaagaggttaggcccagtgtttctagcagatctctgtgcctctcacctgcctaggcagcagtctcctgggttacatatccattaacaatcaccaaactgcttccagccaggcttagtgactgagcttagatcctttgagttcagacagtctagatcccaaagcagctgttctaatgcagaacctcaaaggcccttatcctggtattattgtgctgcagaattttctgagtgtctgacacatacacacacacacacacacacacacacacacacacacacttaatcattgaccttttgtgtgtccttggccacgttatttatgcttttgtgttttgatatctctgttgaaaagaaggatgtttgtacctgtcccacttagtattctgaggtttaaagaaacaagatgttaacaagacactgattaacatcattgtcacgaggctgctgtgatacactgaagatcctaagaacattttgataggaaggatagagtttctttactttccttttggaaacaaacttttctaataggttctggggattcttagtagcaagtaagaatgtaaatgatgagacaccaggtaagatgaagctttacaaattcttttcaaaagaggaccaggccaataaacttacctgaaaatattttcatgggcttcttatacactgaactgtgaactttcccccttaaaatccagtattatttttcttctgtgttattggtaggctaggagagaagcatttggctgcaactaaactcacatgcccaaacaggctaaatcgatcataaatagataaataaagtgatcttttctggctgtattaccttctaagtttccttcagttccagtcagacttttaataccctagaataggggacaatggctattactgggcttagctgagatcctttcctctgggtccctaactggccatgctggcactcttgtagagtcaggaatgtctcctcctgtcaggagacaggaggcatctcaggatttactagtctctaagaaaacctaagtttagagaagtaaaatacattactttaaaaatctcttttgatatatgcgtgaaatctaaaagtattaaaatagcttacaacagcactgtccaatcaaaatttaatatgtacattgataattttacatttttctagtagccatattaaaaagtgaaaaagatgaaactaatttttataatacattttatttaacccagtatatccaaaatattatttaaacttgtaatcaatataaaacattattaatgagagattttacgttcttcttttgtactaagcttttaaaatctgatgtgtggtttccactcacagcatatctcaattcggaccaggcacacagtgctcaatagcctggtgagtggctactgtattggatagcacagggataaaaggttagtagattctgtgtatttttgcaaacattgctaatccatcttaaatttgttaaaaaataaaacccgtacaaaacatatgtctaaatctcacaacagagaccctacagtacatcgcaaattaacttcctttattctgttaacttcaaacatctgtcatcacaaagaatccagaagtaaacaatgagtgaagttccttatgtgcctgctacttcctaagggcagggaaactttgaatcactttgagaaaactatcctaggtacacagggagatgctatgtcctgtgattttaatgcattagaaagtgagcaagctggaagtaattgaggttgacgtggtcagagagactaccctaagagaatgctttgaacacttacaaaaaccttaaaagacactgcgcaataaattcaagggaataaatttatggagagcataaagacttttcatatagtgtcattattttaatacatttgctcatttgtccctgtctatgactaattcaggagaaacaatagaactgtcccaaagtgccataaatggtgattatcttaacatacagtcagagaaaagtccaacaagtaaagagttgtagagaagataagcctgtagttcaatggaagtttatttactcttttcatcttttagcacacatgcttcatgcaaaattctgagcaaaagaactgcagagcgacctggagcattttactgctgacatttactatttccccttttttaaagttggcaaatgttaagggcagttgctacagacagcttctactcatgtgcaaaccatgagaaaaatcacaattcatagttacctataatttaggctctcaagggaaaccaaattcatatgtacatggtggctcctggaaattctgttccaaactcaatttaataataacaataagcaacatcttttgagattttgatagatacaaagcaccattctaagcagtttatatgcattatctcacttaatactcagaaaagcctgatgatttttattatttctccttcacaaaggagagcattgaagtaagtacaaggcatttacacaacttgctcaagatgccccagttggtaagtgatggagtgggggctttaaccctgatccatctcactccaccatccaggtatttggcagctcagcttaggtgcaggccaacatagagattatacttaagagcagatgaagtctcaaaaaagacaaggaaaaggataagggtgctgaggactgaattgcggggcaggccctcaacccttctcccctttccgttcaggttcttgcttcctaatgctgatttttttttttgtcttatgcctcatcactgatttttctttttatctccatttgaccacctgtgacctacttgaccttccagtggaggacactgacatgaatcatctatttggttaaatcaaggactattgagagacattgaaatctctcatttcattcttaatccaggaatttaaaaaaaagtattaaagctgctcatttgagtgagaatgctggaactctgtgtcacacaagataaacgtaagaatagagagccatacatgtttcttgggtttatttcatgtttccattgcaaagtataaacataatagggttagaagaagcattgctttctgtataacttcatacttaggcagaaaggaaaatataaaattacatgtttaagggtgacctatgtggagtagatgttttggcaattgaaaggatgtcattatgatatctaataacattgatcctttggattagaaaggatgagagtccatctaaaaacaacaggttgtttttaagctgctacttttcttgatgaggccaggatagttgtgctgctgctattttagggacctcatatttcttcctgattggttccaggcatttctcccagatatctgttgacatcttgtctatgtatccaggctggagctaaggtttcttgactgtagaatcctgggagaaaaagcagtaaaaataaataagttagaaagatagtgaataaaattaaattttcatcatgacctccaagtacctaaatgatatgccccaccaatctcctggcccagctcaccctggtccagccactctggcttctagtgtgccaagtttattcctgcccctgggctattgtgcttcgaagcagattaaagatgggtggctacacattctttgatagtcttcccatggaaagggagagttggggtccatgcctcctctctatgaatctgggaggactctgtcacggctttgaccaggagaatatgactgaagttatgctactccagtttgacagcctaggccttaagaaactggtgggttccacttttgaaaccttgagttacaccatgtaagaagtccaaataccctgagactgccatactggagaagccacatgtaggcactctggtcccctgtgccagccaaatccaaccttccaaccctccttacaaaggtactagacttggaagtgaagctgtgtcagacatccaacccagttgagcctttgaatgactccagccccaaccgccatctgacacagccacataagtaaactccagcaagaaactgcccagctgagttcagtcaatccacacaactgtgagagaaaataatagagtgatgccttaagccattaaattgtggggttatgtttttatgcagccattggtaaccaaaacacacttgctattccctccacttgaaatgccctttcttgggcctcaactcaaatatcacctcctcagagatgccagagtagcctctcccacccccactggtattctctattcttaatttaggctttctctgctttattattttttatagcacttataaattatatcatgtatatcatattatacatgtatttgtttttgactactttctcctggtagaaggcaagttccatgacggcagatactttggttggaatatgtccccaaaatttatgtgttggcaacttaatccccagtgcaacagttttgagttgtgggacttttaagaggtgattaggtaataagggctctgctctcattaattgttgctgttattgcaggagtgggttagttaattgtgggagtgggtctgtcatcggagaagtggactcctcataaaaggatgagtttggcccctttccttctgctcatacttgtgatttctcaccatgtgatgccttccaccacgttatgatgccacaggaattccctcaccagatgccagcaccttgttcttggacttcccagcctccagaactatgagaaataaatttcttttctttataaattattcagtctgtggtattctaatacagcaatacaaaatggactaaggcaacaaaattatttctttttccattttgtccactgctgcatctccagcacttggctcaggatgtggcagttggtaggctttaggtaaatgttccttgtgtaaatgattgaaagaatgggtctttacccgtatgtgagcctgtcccttttagagcacaattgggcagaccctgatttggcatcactcttaggagaaaacggaaatattttagccacaagcactctagtcctacaggaaaagaagtgccacctagtatggtgtcaggaaaccaggaggtcccccacctcaacacttaacatcaccggctcccacccaaattccacaaataaagactattttctttgtccacagttgagttacagataaactggagatacagaagcaaacaaaacatacaaaaatccctgctcttgtggagcttatgtgttatctggggaggatataaacaaacaaataaaatatatagaaaaatattggtatgcctaaaataaaattagtcatgtttgattttataattgcttttcacttgcagtaacaggcacaatcaagaaatatggctaagtgcagaataaaaaaggctataaaacatggaccttcttaaatgaagttaattcagacgtaacaaaaattcatatattatgttccttgaaacttaaaaaaatgcgactttaaatttaacactctcaattctaatggggatatgagttaattttcaagtatattttagagctcaagtttagttaaccaataacttgctgaattatgcaaaaagctttggctttcaaaatcttattgcttttcccctgtcaagatttaataatttttagtaagggtttgaactttttaaccagatatgccaaatctcccaaatgcatgtataagatgttattatgttaatagcaatgtataatacaatatctgcacacattggaaaatatatatgtgtgttgtattagaaagtgatgagtgctatggagaacgggagtgtggggttatgtgagagggtgggatccaatttcaagtagggtagtcagggagggcctcactgaggaggtaacatttcaacagaaaacctaaagcaggtgagagagcaaaaaacttaaagtataataataataaataaataaattaaaaatgggtctttgggtaagagtgttccagccagaggaatgtgaggttcagaagccctgaagctgttttgtaaagcttacgtttacagcactgcaaggaaccccctgtggctggagtgaagtagacaaaagaaagctgggggagggaaacagtggttctcaaaaaacaaacaaacaaaaaacaaaactctcacctgtagattttgcacggtgtaaatacttaatgtccgatgtcaagctaccaacttaccgtccctgaaggcagagttggaaagaagtgaacacagatggttctcatgacacagtacgcacagactccaacacaatatgaggaggtcagagagagaacagggctaaatggcatagggcctagagggcaattctaagaacattgacatttactctgggtgatgtgggaagccactggaaggtttgaagtagagaagtaacatgatgtgactttcctttgtaaagtactattctgcagaacctccttcatgagcaaatagatgtgtgtgtgcatgtgtgcgtgtgtgtgcacatgtgtgcatgcgtgtgcatgtgtgtgtgcacgtgcacatggccacacatatgtctgtgtctatttcttcttcatggacggcaattcaccccagctgttactctgctttctttgggggcagatacaaaagaagaatacaaatcttttctttttttttttgagacagagtctcactctgttgcccaggctggagtgcaatggagtgatctcggctcactgcaacctctacctcccaggttcaagcaattctcctgcctcagcctcctgagtagctaggactacaggtgtctgccaccatgccaagctaatttttctatttttagtagagacgggttttgccatgttggccagactggtctcgaactcctgacctcaggtgatccacccgcctcggtttcccaaagtgctagaattacaggtgtgagccactgcacctggccacaaatcttttcctatgaagggccaaacctctttcttcatttaggcatttaacccagaacccactgaaataaaaatgacaatattaatcatgatttttagactatgtggctcactcaaccatagagcttctcatacaagtgaaatgcagcacatgtgtgaagccttaatatatcatcacaatctgttctattacttcatctcatcaattggtaattgaagtattcttaggatcctgctgtgttctctagctttgaaactcacagcatcctattcaaactcatgtacatatgtgtgagaaatgggagggctgtcagcagtcattcaataattttgaagaggagcacttcgaaactacacttagaccaacccgcagttgtcattatgacggtcattgctgaaacccactttaggtcagcatgagttagctagcaccttgtggcctgctttggaatttaaagccatcatatgagacaatatctctgaacagaattttaaaattgaagctatacataagaatggtatgggaagtagggaccttctgaattaaaagtttaattttgggtgggtccaaatggtacagatcaaagaaagagaaaatactagcacagtgaccgacttcctgagcacaaatacacaggcttgaagatggaaaaggtgaaataactgaacacaatgtcaagaaaaagaaagaggcagatgcttataaatgtaacagaagccatgaattattatataatgtatcctaaagaatttctctcctagctatgaaagaaacagcctttgcctcaggggtcttttgctaatatcttctagcagccccaagatatgtagacattgtcatatcaaagttcctcagagccttgaacaacatatgtgactgtgtattttcttgggaaagttgaaagctctaacaataaatgcatctgtaggcctggcgtggtggctcacacctgtaatcccagcactttgggaggcccaggcgggaggatcacctgaggtcaggagtttgagatcagcctggccaacatggtgaaaccccgtttctactaaaaatacaaaaattagccgggtgtggtggcacacacctgtaatcccaattacttgggaggctgaggcaggagaatcactggaacccgggaggtggatgttgcagtgagccaagatcatgccactgcactccagcctgggtgacagagtgagactccatctcaaaaaaaaaaaaaaaaaaaaaaaaagaccatctgttttagatactgagagcataggcttagaacccagaggggcctgggtttgaattctgaactcgctatttactagctgtgtgatttgaggcaagtttcttaacctctctgtgcctctgtttcttaatctaaaaaatgaaaataataataccttgcttatagggttgttgagggagataaataaaaataaacgtataaagtcttattaaaaggattttagtatgcagcaaatgtgaaaaaagtgttaaccatgatgatgatgatgatggtgatggtggtaatgatcatgatgatactggtggtggtggtggtgatgatggtgatggtgatgatggtaattatgatacttgcctatcacaatccttatttctcatacccactttctttgtgctcatgacttctcctttgaaatggcttttcaaaaagcatatgggtgtcaattcaaagtacccattaagtgaatttctttgaaaactttttcctcctgaaaataattgtttcaaataaacagatgcctctttgatattctttttatctcagtccagttggtaaagtttgaatgccctttaagtatctccagggtgtcttccatgtaaaattcacaagtagctttttggccaaacttgcctcttccttcatctgaatctcactccaggtttctcctgctgtgtcatctctcgactagtcttcagaatattcttctaatcagaatcttcccagcatccttcttattccctcaacaagtgaatctcctttaaatcaacacaatttctacactagggattaatgttcatagcaacagagctccttttgggaccaagaaaacctttctatttgtgcataaagtctcctttgatttattttaaagtggagttcttatttcaaagcattgactttctttggagaagtattctgactcatctaagtgaatcatcattttggcttgtatcactaaagaaagtgaacacttctcccaaacaatttatggagtgaaaatttggtacctgcaccagcattaatcagaggctgactttggtactggatgagttattcaatggagaagagaaaacatgttgtgcttggataaattcgaggatatgaatttctgtctcataaggctctctctgtagagaaagacaagctaattctggagacacagacttctgttacactcctggggcttcaataactttaccatggaccttgggcatgtaatttaatgcttcgtagaagcttcaattcctagtttgtaaagtgggattattaatttctaacctccaagtgttcccttgaaaattaaatatgataatatatgaaatgactttataaatatcaggtaccttcatcatttttaaaatcttatgtggtagagaacctctttagaaaggagttttttgacaatttgttttttagaaacaattttttctcaactgagataatcacatgtcctcagatttcaaaaggataatctaataatctgaggataataattgacatttaaggaagaacttgttttgagaaaaatcttttattttagaagtcaatttctccctccctctctatccccatccatccttgtatattgtactaaggcacgtacccaggttaccaagaacttttccatcttctcattactttatacatttcagaggcatcaaaagcattcggataatatttttgaaagacaaggggcgcgcctgtcatccggcacctgtgagcccagtgaggctgcagccgggataggagagtggtgcagttgttttggattagctgatctgctctctggggctggagttcagggtccagtcctggaggttcagagagggcttgctagaaaatgcaattaaacgagtaccttccatgacaaggaggtgctagggtaagcatttggggatggatttttgtgctggtaaatcccagcatgctcagtgatgctgtaaaggcgagaagctctgagctttcttctacaaagtcatctgctagttcatacggtagaattatcccagagggaggcaattgccctatgggaggctcaaggtgtgtgtagaaaggggctttgtggtatttattaaaatcataataacaacaacaactaatatccttctaagaactttgcatatatgatctcatttaatctttgccacagccctggaggtaggtattagtacctacattttacagatgatgaaagtgtcagagatgtaacttacctgaggtcatagaattagaatagtcatttcttgagccaatgctttcatcatctacatgaaagttggcaatactttttgtggaaagaaaagtgtagggatagtaaggatgatattagtcaatatctatgcatttactatgtgcaagtcactatgttgagatgtgtatgcattatatcactgatgacccataatactatcatggcattggttctattctatttacattcacattatatacagaggcccagtttgttgcatgcctgagttcatggttacctgctgggatgttgaacatcacaagctgtgctctcacctctggtatctaatatcatgtatctgtacgcaaaaacggactttttgcaagtggtttctggtgtttgaatgttataaaataagagtttgcgatgattatggtgaagctgagtgttcccttttttgtaaatgctattgtatttggttttatttctttgctgctgtacaatgaaatcaccataaaaatcactttatgtctgtagtgaaattttccaaaccataacatatctttatgaacctgaaattttacaattctttaataacagctatttaaacaagcacttttttaaatatttttgtctgtgaaaaaccacaatagatttattaattaaattagaatattagagctgggaaaccaccttctatgtaaattattggtgggagtttatgaaattcttgtagtaagactaaaagtagagtgatcttttctctaagaattgtacttaagctaatacagctgatagaacatgttaaaaatgcatggaagacaagatttcaatatttagacttgtttaagatttattggaatttggagatcaagtggactttaactccaaggtcctttcctaaataactcaaaatgtataataggagttgttgtttaggttggagacctttctaaaacaggaaattcacttttgttcatggcacaaacctttataaggacattaatggtgttttaaaattatgatctatgatgtaaaaataagctttgtcttgagggccttagttagatttgactacagactttcttctctcagtttggtctgttcacctatttgagtatgtttgtagcagctattgctctatgtctcatttcctttagcaaggttctgataagaataatagaaacaattgggaccttgccaccaatctccgccccaaaagaaaacacctcaattctcaaatgaggtcccattaagcctgtgtcagaagtttctcatgaggtctgggccaccccagagccctgggattgagattttttagacattgctacaggctgctgtgcccatttcaatggatggctgttgcagttgggttcctcaagacacagacttggaggtggcgaatagcatgttggtggtttgttagtgggtactgtggggatcaacagccattgattgttggaaggcaagaaggcaggggtggccagaggaataagtgtgatgtagttgcagtggaagcctcagctgacctgacaagggattctgaagatgagatggcccttgggagctgtcctgagtggggcaagagggccaggcctttctatcctcatgtagatagtcattggaagtgaggtgcccagagaaggtgacatgaccttaggcaaagtggattttctgcagctgggataatctctgaagggggctgaaaatcaagggctgcctgccaatagcactccgagtaactgaagtaataagttcctaatttctgaagggcaatctgtgcaagctcatcacagcatctgccacattgaccacttgggaactccactcttctctttagtagttccacgccaaactttgtttattggggcttttgcggaccttgccacctggatgacccaaaggctctggacagagaagcgtaagagtgtctggtgagatcaatagagtcatgaatcctgctgactacactttccatgaaacaacttcctttatccaaagactagggttgccatcaaggggctgttccatacacagccacatagccaggcgaagctatgaagccagccatatgccatgttataattatgatgccgtaaatctctgttttcatggacctgcctctccaggactttggagcttctggagcctggaactatgtcttatttaatttccgcttcttcagtgtatttcttaatgcctgtttcatagcttgcgctttttccattttgtttaagtgttagtagcacttaaaagtatgatgcctagatttctcctgggtctgtccgagcctgtcagtagttttgattgtcttcatcagttacccaaatacagtgttagttctaatttggtagttatcctttgcgttgtcgctctgcctaatactcttaaagtcacaattatattgaagtagagtagaatggtgatgaggtgggcaatgttggtgcctgctgttgcctgtgtgcaaggatccatccaggacttggatcttctgctgcatgagaggaagcaggagctgggaaactagcttgatgttaagcacacctgaatttgaactctgcttatcagctgtgtaatcctggcgaagatgtttatcctaagactcattctcctcatctgtaatatgagttactacacaaatattcaaaaagcaacattattcataatagccaaaaagtggaaacaacccaactgtgtatcaacagatgaatggataaacaaaatatagtatatccatatataggagtattattcagccctaaaaaggaatgaaattctgacacatgctacaacatgggtgaacgttgaagatatgctaagtgaaataaatcagacacaaaaagacagatattgtatgactttgtttatatgagcattattactatgtgctctgaatctcttctggccactaaacatggtttcaaatgaacacactatcagatatttatttattcttcaaagatttattgaatgagtactcctccaggtactgggaatacaccagtgaaaaagacaagatttctaccttcgtggggattacattccagcgtggagaggcactcaatatatgtatatatatatgaacaaatgtaccacatagtctcagttgctatgaagaataataaaggttgacgggaaaagcatctctgaggaagtgacatttaaatagtgccttgtgaatatctggcagataaatattgttgaaagagggagtgacaggtgcaaaggccctcaggcagggataagtttatgtgtctaaagaacagcagggaggcaagtgaacaaagggagagagtggtagatggggaaagagaagtacaaaagccgtgttgcccatggaaaggactttggagtttgtgtaagcacgataaaaagtcatcagaaggattttctcaagggagtgacatgttctgaattatatcttacaagactcactctgactgctaggagattctgggggccaaaggtggaagcagagagagaattaacaaagttaatgcagtaataaaggttagaactgacagtggcttggagcagggaggtaacagtcaaggagatgagaagtgattggattctagatatattttgaatttagaactggtcgttttgatggctgattatgtatgggataggagaaaaaaagaagtcaagcaactgatttcgggcaatctgctttacagatgaatggattattattgtctagcagtaaaagtaatgggggatgaggcatacagaaaacaatagaatgagtcagtgaaattcaccagactccccaaagaatcgttttggtcagtagttaaaacagagagctatagcagagagagagagagagaaaagaagaagaagaagaagatgaagatgaagaagaagaaaagagaaaagaagaagaagagagagagagagaaaaggaggaggaggaggagaggaagaaataacttctgggaggaagaaatcctacactagaagacctcaggctcttgttggtagtcattggagatggccttggaagcttctgaagctcatctactaaagaaaaatgtgtcttttgctgggaggcatcaaacatagaaatgtggatctctttcctcagggtagcctagcaaccaccagcctggcacagcacatcagcaatgcctatgtcacctattacggtgaccactccaaatccaatgccactggaatccaaaaaggaacttgatttttaaaccccttcctcttatttctctctcagaggaagtcagtcactacagcaagtatggacattgaacatccctttccagggaaattaccttgtctagtgatatggatgtctttacagtgcatcaggttggttaggaagcttttctccataacaatagagcaatgctggctgtagaaagttgaaagttgaagtctctttctactcaagtagtcaatgaatctactgtatatttctgtatattacaacattccagggctcctttgctggctgctaaccctcctcaccctgaactcagaagttacatcaaccattcatttacttacagtttcattgagatctaattcacataccatgcagttcaccactttaagtgtacaattcaatggatttttagtctattctgagtatgtaaatttttgttgatgtatagcatacatacagaaaacaggacaaaacataaatgaacagctgatgaattttcaaaatgaacatattcataaagccagctttcatcccgctacagcccccacaggcctcctcatgttcccttactggcattacacatccccaaggagagccagtatcctgacttctatcaccatagattaattttccctgttttaaaactttctaaaaatgaaatcttatagtatgtagtctttgtgtccagctgcttttctaaatttttgctgtgaaattcaatcatgctattaggagtatttgtaggatgatttattccccttgatgtatggtataccattaaggaactaaagttctttttttgtccatattgctactgatggatagctgtatggtgcacgattaaggaactgtaatttattttttgtccatattgctattgatggatatttaacattttcgtgtatgtgtttggagaacattttctggggcgtatacctagaagtgggtcatagtaatgtgtacatgcagctttagtaggtactgccagttttccaaaggggaatatactatattacactaccattagcaagatatgagagttctggtggcttctttacttcaccaacacttggtgttgtcatcaagctttctcaacctcatcttcctggactctggccagaaggcccctgagtaagcttcaagtaccttctcctggtgttatattatctatatgtatgcactctgctggagagacttcatggtttgcaacaaattttcagaggagcccttgtcccagagaagggcaaaaactacggcttccagttttcagctttcttataatctctaatattgtggtgaaacagccttttatttgagccaagatttctcctggaaaagctgacactggtagatagtcgtctctatttttgaaaagcacattattcaaggccagaacactctggagttttgctagtgctggtgtgcatgttgagcaatatgttggggatatccaaaaattacatgtcctaaataaagggatgatatttattgagatactttagatgcctgtgctatttgatcaaataaacacttatgtgtttacaaattgaaagagtgagaaagttggcacagcaaaaccaattttagtcgtgggcattattctgctttggaaacaacctcttggcatgatggcatgtcctgatggttagaaatgtgatacagttggaaatggctgatacagctgaaaatggctgatacaagcagcaaagaattagggtcataaaaccctgcatccttctgaacacacccttattctttgaggtcaatgcatggactaattttggagacttctgtggaactcaaacctgtctccactgacagatgcatttacaccagattatgagggtaaataggagaaagacaggtctttgagggaggaattacaattttcagcttcttaaacactttacttttttcagaataaattaattttgattgtgtttagaaagcagtcaaacttctgactcagactctgaagaattcttcttattttagtactgtttatccagtcatctatctatccattcattcatccatccatttccatccttacatctgtccatccaaacatccattcatccatccaaccatcccatgcatgtcaaacaccaattgaatatataacattcttaagcattatgggatgatacagatgattggttcatttcctgatatagctggagagggaagacatacccacatggaatacctagagaatacagtactatcaagataacatgggcaagtacaagttaagatggtagggactcaaatggagtgaactttatgtgcagagcactgatgggtagtgagatgaagcttggaaggcttcttgaaggagtcagtcttgagctttgcaaagaaagttgtttatactttgcgctgatggatattagaaaataaaaagcctttgaggaaagatgcagtgatgatacactggtgaggagaggatagcctgctgacatcagggaaactgcttgaccagagcacagaggcagccaccttcttcttggaaggcatcttcttcctggcagccaccttcttttggcagctttgagaaccaggcacaggagcttgaatttgttccagtgaacaaggggacagtccagttggaaaagagataagacaaggctgcccccttctggtttcttgtgcagtccattcatgctcccatctgaagacactagggcctctgcctgcctggagcattctcccctccagatattcacatgatttcccccctcacctctttcatctcttcattcaactgtcaccttctccttgaggccttccttgacatcactttaattaaaattgcaaccaacctcaaaccaccaacacttcctctttgccttccctgctactttgtcttcacagcacttttcaccttctaatctactacatgattttcttatctattttgtgtagtgtctgttttgtcagtttttccttgtttatacctactagaatataagctcccaggagagcagacttttatctgttgttcctccagtgcccagaacagtgccaggcagacaggaggcactcaagaaatatttgttgaatgaatgaatgaatgaatgaactgatgtgacagccattagaggatggactggactaggccttgcatgggaacaggagggacagccacaaaaatgatctggctggtcattgagtccgtcattagcttctaactagtttgtaagaatctcaagtggttacttgattaaatgccttccagagactatctttggaccacatgagaagtggctcatagagcagagacctgacaagagcttgaactctattactcatgtgcaatttattgtatgtcacttatgctgcaataaagctgtttaagaagaaagaacgtgagctctacctacacaaatctgaggttaaattcagtttctgcagtatgcaaactgtgtgaccttggacaagttactcaaccctatgtgctatgaaactcaactgcaagatgaaactatcagcagcttactcactggatctttgtgaggattaaatgaattaacttaaacctattagcccagtgtctgacaaatagtgttcaatcattataattaaaaggaaaggctgggaagcttcatgatcgagagcattggtctttgaatgtctgaatttaaatcctgctgccacatactagttgtgagatcttaggcaaaatataattatttatctctatatgcctcagtttcttcatctgaaaaggacaacatgatgcctatctcatagggtcactgtgaagattgagtcaatacatatgaagtgcacagaacagggcctgaagagagtaagcactcaatactacttgttgtcattattgcttcttattattattcttgcagggcttcacctggtttctcagccactatgactcccatcttccccatttctttctatgtggacaatcccaggcctttcacatgctgtggtgctgctggaagattccaaaaatgcagcattgccattgtctgcacctcactccagtttcacccatgtgatggtgcaatcagaagacagtgtcagtgccaattctgtgtgcttagaaatgttagcaagcaattctataagaaaaaaatctaataattatctgatcaaaaaatggacaaaacattttaatagacatttctcaaaagaagacgtccaaatggcaaatagacatatgaaaagctgctcaacctcattgcaaatccaaactacagtaagatagcatctcaccccagttaaaatggcttatattcaaaagacaggtagtagcaaattatggcaaggatgtagaaaaaagggaatatttgcacattgttggtgggaatgtaaagtagtacaaccactatggagaaccatttggaagttcctcaaaaaactaaaaatggagctaccatatgatccagcaatcccactgctgggtatacaccccaaagaaaggaaatcagcatatcaaagaggtatctgcactcccatgtttgttgcagctctgttcacaatagccaacatttggaagcaacctaagtgtccaccaacagattaatggataaacgaaatgcggtacatatacactatgaagtactatacagccataaaaagaatgagatcctgtcatttgcaataacatggatggaactggagatcattttgttaagtgaagtacaccaggcacagaaagacaaacatcacatgttctcacttatttgtgggatctaaaaatcaaaacaattgaactcatggacatagagagtagaggatgcttaccagaggctgggaaggatagtagaatgttggtgggaggaagataaggatggttaatggataaaaaaaaatagttaaagaatgaataagacctactgtttgatggcacaacagggtgactctagtcaataataatttaattgtacatttaaaaacaactaagagggtataattggattgtttgtgacacaaaggataaatgcttgagggaatggataccccattctccatgatgtgattattacacattgcatgcctgtatcatcaaaacatctcatgtaccccataagtatatacacctactatgtacccagaaaactttttaaaaatttaaaaaattggaaatgtgaacaagggtcatgaaataggcacacgaacagaagaagacaaccatttgcccaactacaatttgcaggacttctcccctcctccctgatgggaaagactaattttattttctctcaaactgcaagtataggtcaaaaggaaagcttggtccttcaaattagtttatggcccaagaacaacccttgttcataactgtaaaaatgattgagttatagaggggaaggtggcttaccctggctcccaacagttagaagggcaaggttcccatgaacatcagaggagacattctgagagaaaaaggtcactcctcaggaactgaatctgagaaggaccaggccacctgtttctactgacagggactgggtccagcatcaagaatatgatggcaaaagggcttcccaaatgtgacagaaattggggtgttgggtctttacctccagaacagaggtaagaaggggagaaggacatgtagaacattgatgttgataatagtaatggatgtgtgacccagccagcctgtttctgagagccactcactcactcactaggtgacaattctaggaagtggagttcaaatgttttaactgaacatacaggctccaaaatgaggccgtgtgagaatcagtttgcttactgtttttcagaaagtctgctttaaaaagtcaaagacaaattttcatggcaggaattcttatgctaggaattcatccagaggagattcatcaaaagtgtggtcatggatttatgggtaagaagtggttgtataaatgatggtacactcataatgatcacaaaaccatcagcaatatccatttagtgcatgcatcctgtgtaccttgtataatctccattattcctacagtacatccaagataggtatcatgattccaattttaatgataagagaactgaagcttacaaatgttgagcaatttgcctgtattcatacagctattactttgaagagctggttcaagtcagttctgttggtctcttaaaaatcatcgtgtaatccttctaatgagattctagtccagagcctctaacttttttacattcttttttttattattattatactttaagttttagggtcttaaaaattattaagaattccaagtagcttttgtttttgtggctctatctctctatacttgccatcttataaattgaaattgagaatcttaacaatatttattgacatgatttaattacttaaaataacaataataaccctactataagtaaacataataaatttttattaaaaactgttttctaaaacaaacaaaatgagtgagtgacattaatttacattttgcggatcttgttcacatctggcttgaagaagacagtgaccatggcagctactgtaaatcaaattgaacttccaatagctttcttttttttttttttttttttttttttgagacagagtctcgctctgtcgcccaggctggagtgcagtggcgcgatctcggctcactgcaagctccgcctcctgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccttccaatagctttcactcatgagctatgagatcccaatctagtcatttaaacttatctgagctatatttcctttacctgtaaaaggaagaaataacttctgctggacctacttaacagggctgctgtaatgatcaaagaaaaatgctatatgtaattagaccttttaacttaggtacatcctaggacaaggacttattctaatgtcttctcatgatttcttcagaagaacaagcctccctggacaatgttcaaaacagtaataatcactggaatgtttccatcatggccaaatgtgaggcacaaaactcttgcctcagattgtgtaatcttataaacttagacatttcctccttaccccacttactccctgaagcttgaagatttgcaaatttttatgagtctaacaatagctctttcctgtgtttatcagaagttttccctaatcttacaaaagaagatttgtttttatgaatttacctaaactaagctgttgcctgcttagacataagacaccaaggaggttaaagggtaaagtgttttattctgcttcatgatagtttcctttacatattgtttggttcccatttactcacacatttactctgtttttggttttagagtcttgagcaaacctcctttctaggagcattcctgagttaggagggctttaacagctggtctttgacaccattgcattgctgggattattgctatttgggcaaccctcaatatttttgggactccattgaatgagaatccgtataattcagctgaggtgacatttcaactgggttattcagatgggatctgtcaaatagagtcttggaaggggccccttcccaccctcatcacagcatttccatatgacatgtactgtacaaataatttatctctggggaaaggaaggagggatggtggagaggtgcccatcttatgtgttctggtgggaggttaatatagaaggatatggctgggtgcggtgactcacacctgtaattccagcactttgggaggattacttgaggtcgggagttcaagaccagcttggccaacatggtgaaaccacgtctctactaaaaatacaaaaattagccaggcgtggtggtgtgcacctgtaatcccagctactcaggaggctgaggcaggagaatcgcttgaaccaaggaggcagacgttgcagtgagccaagattgtgcaactgcactccagcctgggcagcagagcaagactctgtgtgtgtgtgtgtgtgtgtgtgtgtgtctatgtgtagatatagatatagatatagatatagatatagatatagatatagatatagatatagatgtgcaggatgcttttgttgggcagggctccacatgcaggtcatggttagttagttaactctgccttgttccaaaagctgtccttcactttttcccaggccaagtcccatgtgtcagactgagctctcactttctgaatcaattgtctttatgtttccaggagctgccatggttgctggtgcaggccctggcagtgacagacagacattaattaaccacatctgctgggctcacattcttcttcaagtcatctggtggtgatttctggctgaaccaatgcatttgtgaaaacaagcaaacaaaaaaacctaaataatttaattgtttggctgaatactgatttcttcctatctttttattaatggattttcaagcaaaaatatgctgttcttcccacttatggtgtggctatttagctgcttatggttttatctctttgtgattccctttactcgtgggcacaatgccacactgatagtgcagaaggatgactttgtacaccagtcatagatgcacattgctctcaatgtgcatcttgatttggttctttgctatttaagttccatcccacacccactttgtacaagtgcattgtgttgagggggcagggttgggcactactctgctggtagggatctgcagagaccatagtgggtctgggttcaaggggagacttaaaacaagtaggatagatagttataacataaggaaccaaagtacaaaagatcagtttataaatcggggcattgtgtgtcaaataaatgacaagttcaaggtcacacagctgagattatatcaagcatatattgtgaacctactgtgtgccagcagtctctgccagcacgtcctaggcatacaaagattataattataatagtagcagctgcggtaataatattgattgagaacttacaacatgccagccactgttcaaagtgatttacatgtatcaacacacttcatctttctaacatgcctccaagacagttactatgatcacatttcactactgagttaactgaagcacagagaagttaagcaacttaacacagctagtgagtggcagaccatgactcaacccagggagactggctccagagcccatgctcttgcagcgtagggcccagtgaatgagatagaatagtaaatgcatgaaactggtgcagtggagttagcggcagatgaaagagaaacagagagctctgggacactgagaagaccacctaacccaactgtttatgctaatctgggcatacttcctggaagaagacgatggagtcaatagatgttgaattacaaagactgatatctggggcctggacgattaagtaactgtcttactctgtgtcagtcatcttaggagaggcagagctagaatggggattgacttcttcttcgtggagaatggtccctggatcaatccacaggtttctgctgagcaagttttatgtattgaactctgatgaaggagggataagtggaggttttcaggtcagcatgcaagttgtatggaacatgaattatttctcaataaagctgattataaaacaaaatcagcatgcactcagcagccagaacttgcttctaaataccactctcttgataaaaggaaagccttcttggacaaatgacagatcctagggcttgggcagagaaaatagaagatgagtctggagaatcttctagtgccaaaaatgaaaaaaatgctcaacagacaaaaggatggggacatgtcaaagggactcaggagccgacctgaaggagtgctcagaagtagaataatttgagcaacaaataaatcatattgtattagattataacacaaggtataaaacacatatatatgtccactgttataaataaatgaatgaataagcaagtaaaaggggaaaagaggaaaatcttccttagaaaagaattcaaaaaatttgtggggattctccatctccagaaagtggaagttagctcccaccatcccctcttgaggatgatctgaacttaatgactctcttccaaagaacagagcatggaagaggggtgagtagcaactctacagtggagagacctgacagacaccaccctaagcaaggaatcaaggttaacatcatccgtgataagtcatattgatatcaagtgccctctgaggtgacatgatgacaagagcacttggtctttgtggtagtcttccccaaaattcatagtcctaatctaaaaatgaaaaaagtaacttcagacagatccaaattaagggatattctaccagataactgacccgtattcttcaaactttgaaggttatgaaaaataagggactactgagaaactatcacacaccataggagactaagaagacaggacaactaaatgaaatgtggtatcctggatgggatcctgcaacagaaaaaggatggttagtggataaatgggtgaaatccaaataaaatctgaagtttagtacatagtgatctaccagtgtcgatatcctggtcttggcaatgtaccatgtaatgtaagatgctaacattagagaaaactaggtgaaaggtatatgggaactttctgtactatctttgcaacttttttataaaacaaatattactttgtaaaacaaagttactttgtaaaaatttgtaaaacaaattactttgtaaaaatgtgtaaaacaaatagaaactatatttaaagcataaagcataaaagaaaagtcagcaagtgtcagtattctgatcaactagaactttcatgcattgctgttggtaatgtaaagcagtgcaacaactttggaacactattaaacttaaaaagttaaacatacacccactgtgtgactcagccattccactactaggcattgacccaagagaagaaaaaaacatatgtacacaaaaagacctgtacaagaatgtttatagcagttttgttcacagcagatcaaaactagaaatagttatcaacaggtgaaacaaaccgtgatgcatccatacaatggacactacttagcaataaaaaggaacaaacggaaacttggacaaacctcagaaatgtcatgctgagcaaaagacgccagatacaaaggtgtacatcttgtatgagtccattaaaaaatgtgaaaacaggcaaaaacaatctataagtgacagaaaactgaacagtggttgcccagggccagaaaggggacagggattgtctaggaaggggaaagagggaactttctggaatgatgggaatgttttatatcttgattggagtggtagttacataggtgtacacatgtgtcataactccccaaattgcatgttaaattatttaatgtgggtacatttgtgaggagatattggtcaaaggatacaaaatttagttagataggagaaataagttcaagggatgtattgtacaacatggtaactatagttaaaaacaatgtattgtagtcttgaaaattgctaagagaatagattttatgtgttctcacctcccaaaatgataggtatgtaaggtaatgcgtatgttaattagctcaatttagccattccacagggtatacatatttcaaaatattatgttgtgtattgtaaatatatacagttttaatggcaggttaaaatttttaaaattacttctaactataaaaaacaaaatacggaaactaaactaaaataaaatgagtacattgtagctaaagtacacctcaatagtgttaagaagggtgacagttaattttatacgtcaacttgtgtagatatttggacaaacattattctaatgtttctgtcaagctatttttaagataaggttaacatttaaatcagtagactttgagcaaagcagattaacttccataatgtgaatggactttatccaatcagttgaagtccttaagagaaaaagattgatgactctcaggaaaagagggaattctgccagcagactgcctttgaagtcaaactgcaactcttccttgggtccgtgacctaccctacagattttggacctgccgtccctctcaatcaacatgagctaattccttaaaataaatctgaatccttctctctttctctgtttctctctctgtctctgtctctctctccatctatatctatatcaatatcatctatctatatctatgtatctatgtatctatatatctatgtatgtatctctctctctctctctctctctttctcctgttggttctgtttctctaaggaatcctggctgagaagaaacataaagctgtatctcaacccttccctgagaatcttatggccttgttggagagagaagaccaacatggccacagaattaatacaagaacaaatacgaaatctcttattccacaattctagtttctctgcctgtacaacatcaacagaaggtgcatctttattgaatgactcagagttttggggaagtttctgttgactgagaaccttaagttattctgattccgttgaaagatgctatcagaatgcacgacctggcttctgactcgggttttcagattgacccaaagtgggtttttttgcgtgtctcttaagtgccatcaacaggttaattctcccagatattatttattttaaatccttggaacaatgtgttccctttatttctgtgtcgaggtatccctgtgggaagaaccaggtggtataacatgtctagaagagaagtttgaagttgtctaatctttctgctttgactttgctgatctctgggaactcctgtgtttacctagcacatctgagtccttgggaaagctttctgggccctgttttgtggttcttctaacagatggttgcattcttgtgattgatttttgatccccttctaagttgtataatgcttatagttataattttctgactctccaggcacacagaggctcctgactctgagatatttgcaagtaccattgacaaataagatttccttaggttaactccacttatgtacttgtatttacattttgtatggtaaaggctccagtttcagagagaaacctctttaccgtgcttggtgtggcagtgaacttaattaacagagaattttgctggcaatctctatgctaaaaagttaagtggggttctgaggacacaaggagctaaaaagttgagtgtatatcacatattgataactcacataattttgcttgcagacatttaccaatttggcagattacctacttttacattgtagtaaatatttccttttaaaaatatcttgtatctcacagggcaaatcataccccttcagggggccattcccacctgtatggaatccaattacctacttagatcataacaacttttggaggacaatggatgacatggggcgagaggtaaagcttctttgactatatttgtattcttttttgtaataagtttcatccttcaaagaaagaaagtaaaatatatctccaacacctagcacattgtgaacacatggtaactaaagatttgtgaaatgaatgaatgaacttgtttctaacctctgcaataataagatgtcaaacagattgatatttgtatactactgatgagtgggcaggagattgggtgtcactcagccttcttggaatgatgtttcaaattttggaaatcttcagtacatagcaaaattagacttctgggtctttgattcaccaccatgcccaaacaagtcataagtaatcacacataaagcattttttttcttttactttaagctccgggatacatgtgcagaacgtgcaggttcattacataggtatacatgtgccatggtggttttctgcatctatcaacccatcgtctaggttttaagccccacatgcattaggtatttgtcctaatgctctccctccccttgccccccaacccccgacaggccctagtgtgtgatgttcccctccctgtgtccatatgttttcattgttcaactcccacttatgagtgagaacatgtggtgtttggttttctgtttctgaacacacataaagcttaactgaaaactccatagacatgatttgctgcagctctgtgatccttgttaaatagttaaatttatgagtgttctctagaagttagtaacttaggaatccatatctagaaatagcccagttacaacatgcctctatttattgtgcaggaagttttatcacaaattaaatatggcttgggtggtacagatttataataggaaagctacatagacagcattgattatgcagtaaaagcaatattggatgaatttggaaaacttaacatttttcctctttaaggtagagtttttaatactatttgaatagttatttaaagtggaaaattacaaaaatgaataaaataaaagagaaaattacatttgtctttctccttcgaatcctcatctgaatgtagattccgagtgatgccccatggaaggctccccttgcagaagagtgggacaacatgacaatgaaggagctactggacaagctctgctggactgagtaagtcttgccattaggcacaggcatttactgtgaccaccttttaggtttatttagcaataccgttcaacaagtatgggacaagtagctgctttgtgtctaaaaccacaccaccagccagtggcatgctgaaaaccattggaattggctcctaccctgaagatatctgtacatacaacttacttctttggagtagttttgtatcacaaaggtggtattaccctgtgaagtcctcagaacagaccagaaggtaccactttctttatctgaaacagcttaaagaccatcagcttaaagctctcatttattaagttgttgatataggacaatttttgtattcttcactggtggtcaaatgtggagatggttagcatgtgcatttgccacaccttgtgtgaagtagtgcaattcttcaaggacttaaagaggaacctctaaagcctttgtgtagataggtcacaactacaggggaaacatgtgtgactggactggctgttcccctttagtgaaaaaacaagtacctatgagttaagcattaaattcttgttggcagaactgggaactgtagagaaattgtgaaggcttgtatagacagaccacatggagaggccacactgctcttggacagcagggaaaatggaaaggattatgagggttcccattcaagcacgtggtaaatttgtggtaaacaaaataagagaaatggaagccaaattcaaggagactgccctgtcttgctaaagagcattagttgagaatatgtttggctcgggggttaatgtcttcatttttaggcattcattcactgccaactaaaagtaaaaacaagcttttagaatatctgaatcttaaaaatggaaataatcaaaagacataaaattcatatatttttcatataaaaattcagcttctaataatttagctttaagaaagtgaggcaaaagaagagagaggcaccagcatggcacatgtatacatatgtaactaacctgcacaatgtgcacatgtaccctaaaacttaaagtataataataaaaaaaaaaaagaagagagaggcatacagggagagaaggagagagggagagggagaaacagtgaaagaggcagattcaaagcattatttttaaaagggaggatctgaaagcccaatagtagaagatcggcagaatcaagtatggaacatctaaaaaattgagtacttgagggttttaaaaaatcgtgttgtagaggaatatttaatgactggaaaaaatagtaatattaaacacatagaaaagcaggctattgtggtatggtatatgatctcatttctaaaaacaactatttatatatgcactgcaaaagcaatggacatccattgaagtatttttaacgtttaatattaccatgcaaacatttatttttaaaatgtttaaaaactttacatcattaaaaattattctttaaacatcatatttcatggtaccagaatattccatgggaaatgaatacgtaatgtatttgtccattatcatcctgttgaacacattggttactttctgttttttgttattatcattatacaatactctataataaacatctttatgcctctcctgtgttttcaacctttgaaagcaaccagttctggaatagtaaaatccttttatgtcatgaaatcaatgcgtgttattaattatattcttttaaacatttacctaatgctatctaacacctctatgagaatgtagtttgcaatataatttattttaatagtaataaaattgtagtatttagttttaaattatatactttagattttcaaaatataataagtatgtaattatctgcatttgttttataactcctgttatgaaaagcttttaataaattcagttaggtcttctctcctcagagaacttttaagtttcttggtgataaaatcaatcatatgtttttgggatcacagggacccgacattttctatcgtagcccttggcctagtcctccacttagtgaatattctaagttgtcatttgacaaaataaagcattctgagatactaggagtataagaacacaagacaattttccaactcttcccaagcaagatacacacagtattatttcctggatttaaatgaagtaatccccagaatatccaacctattgttgttcaaactaaagcacaatcatacattccaagactaatgttgattattctttcagttattatcatttacaaagtgcacttcacaaacatgaattgtattttcaatgtgatcacagctatgtaaaaacattttttaaaagacctatacttagaaaaaaatgcatcaaaatgagactagtaattatcttctggaggggcagaaatatggaagacactcgttctctcatccttttatcttataaattttccaaattttatataatgtgtatgtatttttcatgtagaaaaatattataacatttatcttttaaaaagtcaacagggcaaaaaatacggaaatattgcactaacttccttgaccttccatccttcaaatattgttcttatttcttttcttactgaagctcctagagtaaattcaaataaaggattaggaatggactggcccttcagaattacttttagatctccctttatttcaaaccagaattatttctttcccaccaaattgccaacaataacaactagaattccagcaatatttttgttaaatattggctctccagctgggccaatgttaggtttcagttatttattactccctttactgtatgcccctcaatccacctaaaaaataaggaagaaaagaaataggattttaggaagcaacaaataaaatactacttttattttaaattgacgtctggatatgtgttttagttagatattacaaattgcctctgcaaggaaggcatgagctagcaatttccatcccttcaattatcctgagaaatcttacaaaactaactgtaagtcgctttaatgtatatatgacaccatttcacaggctgtaatgatggggactgtcatagacgggctgtcaggttgttacagctgcaaataatgtcaataattggtatgtgtgttaggcatgattctacaaacttctagggtcaagatacagtaaagtagagagatgccccttggtgagtagctgcacttccaaggctgtcagctgactaattagaaaacattttgaggtatcaaaagcacgagttttgcgtcaagtacgatctgacttgaagttgtgtcgttatatattcctaaactgtccgagactccgttttctagcatgtgaactgtggaaaaataatagatatttgatacggttgttgcaacaatttaacaagataatgattttaaagacaatggagtgtggaaagagttcaataaatggaagacaatatcatttatcccaaccattgtcagcattaccaggtggaaaatgctgcctcagatataacaagattaacaatatgcaaacttcatgtcaaagtcaaaaggggaattggaccttattaaagaaatcccagagtgcacactactactgatgaattttatgctgtgctagatataatggagtcctcgaaattgcatgagatagtttgctttctggtgtgcttcctgataggtgataacctctcaccatttacctgccaatgtcaagcaaaagcttacccatttatgctctattaattgtttgtcccctcatccattatttgagcttgtcttctgttaggcagtaaaataactgaatagataactgtgactaattttgtgtttggtacagcacctagcatatcctttgcatgttatggatgtttaaaaaattttgtttaactgatatttctcatcaatcattcattcgttcaatcatgcaacaagtaattattgagtgcttacaatgttccaagcactattttgttaaaggggacactatggtgagtgagaaacagaagatccttgttctcataggttgatattctagtggggggagacagcaattaaaaagaattaaccaataatcaagacaatttcagacagtgaaaagagttataaagatactatacagtagcaaaatgatagagaatgtcaggatgctgggaatatggaagccagtggtcgttttcatagacaaatgtgaatatgtctttctaaggaaacattagagtaaaaagaagagggtacaagatgagacagaaaaggtaggcatgggctggatcacatagggctctggaagccatggtgtaagatctgaatcttattctggttttaataggataccactggagactttttaagcaagaaaatgacatgatttgatttatacttcagagagagcatcatggtagggagggagggaaaagcctctggctttgagtgtggtgaacagataccaggtgaggatgaatggaggcagagaggccagtctgaaggaagtaattgcagtactcctggaaagagatggattctaaatttgtggtgaaggtggagtgatgtggtgagagataatgggacttcccaatgaattggatgggggaagattgatggaaagagagaaataatgtttgatttctagagtgttggtttttaccactgagtaaatgatggtgctttttactgagatggggatcactggaagagcagcaggaatgtaaggagaaatcatgaaagcacagaatctggaatagaagctgattctgagtaaggtgttttgtttacagggaaaataatctgatatttcaaaaacctccgatgtcacgttttgtaatattagattctagtgacaattttttgaccttaccacattgttttaaacttaaccaagaaaatgtgttacttaaataatttttagagaattaagaagctgctctcctgcgtttgccaagtttgctcttgtttcttcctgtgcagatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggtacccatccattcttccacagtcccaatggaaaaacactgctactgaaatgaaagatcatcatccttcaatcatgaactgctgaagtgggaagcaggcttgtggcttttagagcattaccatggcagctcaaagtgtttcttgtaaggcagtctgttgtcaggtacccactgtgagaacccagtgtccaatgtaattttaaagctaggcttgtctctctttatgcactgtggccattttccatacgctcaattattatttggtaagtttgtaggagaccatctgaattaagcttagcttgagcacttcttggaaagcttataaaggaaattcagtaatgcattttcaatttaaaacacacactattcatggaattcatttatctattcattcattcaatgcccatttcttgagccccggcactgtataaggcactgtgctagacacagtaggaacatattggagttcttaaataatctgcttggttgtcatgttccattcttctctctccccctcctcctcttctttctttctcttctcctcctccccctcctctttctcctcctccttttctctttctccctctccttctccttctctgaccttaactgaaaattgaggaggaggcagccaggtcaactgtgtgcatagccaggtagaacatttggaagttttagcaaggctgagggcaggtgggtacagtgaggtgaaatgagttcggtggctacagaagcagcaggcatctgacccaggataagatgggcagcctgcaacagggagtaggctggcctgggggaaggggacatggtgggaggcagggaagttctgcgcttgagccacaaagcaaggggaagcaggcttaggtctgctcaggcaagctagggaagagctttaggtacagcttcaccagttccagctctaagcaaaagactgcagataggacagagagcagggatggtgaccagaaaggtgggatacaggggtcattctgaagatgtccagctaaggttggagtctgggaatctacaagagcatagcttgtaaagtaacttagaaatcctgtaactttgtccaaagacagcaattcctacttagaaaaccatggtgaaagccactattcactgcagcaaaatgaaatgttagacatctcagagtagacatatgtgaggacaactaagaatttagcaatttatgcccattcctgcgtttctctttcacctccttttctctttccaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggtaactgtgatattgtgaaatatatatttgatcttcatcccagtttcctggcatacaactttaaaaattcttagaatctccagagtgatgtcctttgatgccaatgattgatggctggcagcccctaggtagcttcaggatggggctggtcacaggaaagaccatggaaagactagagggttgggactttcagccccacccccagcctccagggaggggatggggcaaggggctgaaggttgaattgatcaccagaggccaatgatttaatcaattgtgcctacataaggaagcctccataaaaacccaaaacgaccgagttctgggagcttctggatatctgcacaactggaggttccttgagaatggcatgcctggggagggcatgaaagctccatgccctttctcacaactcttgcccaatgcacctcttcctctgtaccctttgtaatatcctttataataaaacagtaaacatgtttccctgagttctgtgagccactgtagcaaatcaatcaaacttgaaggggttgtaggaacatcaactggaagcagattggtcagaaattctggaagctggacttgtgactgacatctgaaggtgggggacagtcttggagactgagccctcaacctgtaggatcagaagttatctccaggtagatactgtcagaattgagttgaattcagaggacacatggctgatgtctgctatagaattgcttgcttgcttaatatgtggggaaaaaccactccacatttggtcacagaagtcttctgtggtgatcgttgttgagtgagagaatggaaaaaagcacttttttccattctctcactcaacatttgctttgaactcaactttgctttgaaatttttccactcagagttaccaagacacttaaacaagtgggaagaggccacagtctcatagataatcaaagccgaagtcaacaatgtcacacactttatagacagtctttttgccaatagtgaaaaagctatctctaactgaaaaaaaggaaaagagaaccagaatatttggggtgggggaggatttataaaaacttataaaggtattatcaaccctctgtattttgcttttatgtaattagaaaaacacagaaaatatttatttgataaatatcaagcacctcctatgtgcctgacatgattctaggagttaagaacacagtcgtgaacaaaacagatacaattctctgcccacatacaattctccttctagtgaaggagaaagacagtaatgaaacatatagttataatataaagtatgtcagatagtgataattagtgcggaaaaaatcaagcaggaaggtggggagagggcataccagaaagtgagatgggagaattggttatgcaagtttaaataaggtgatcagggaaggcctcactgagaaggtgatatctgatagagaattggaggagacgagggattgagccatgtggttccctgagagaagaagatggaacagccagtgccaaggcactgaggtgggagcaagcctggtgtgaccaaggaacagcaaggtgatcaaaatggcagggccaggcttggtggctaacgcctgtaatcccagcactttgggaggccaaggtgggcagatcacaaggtcgaaagatcgagacaaccctggccaacatggtgaaaccctgtctttactaaaaatacaaaaattagctgggtgtggtggtgcacacctgtagtcccagctactctggaggctgaggcaggagaatcgcttgaacctgggcacgtggaggttgcagtgagccaagatcgcaccactgcactccagcctggcgacagagtgagactgggtctcaaaaagaaaacaaaaatagcagaagtaagagtgtcagggcaaatgtaacaggaggtgagatcagtgatgtaacgggcccatttcatgtgtggccttggcgatgatggtgagaaatctggctttgactttaagtgcaatgggaagtcattggaggttttgaactaaggaacaataagggctactttaggtttcgacaaaatccttgtcacttctttaagagactgaaaagaatataacgatagaatgagagagaatcattgggaaaaaaacaaaagcaacacggcaacaatgtttaaccatgttgcttttctttcaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaagggtgagtactttccttatataaaaacctttagaagaaggtccaagaaacttgttgctaaggcatgcattttttaaaaatgtcaacttttattttagattcaggggtacatgtgcagatttgttacatggatatgttgcatgatgctgaggtttgtggtatgaatgattctgtcacccaggtagtgaacatagtaccaataggtaggttttcaactcttgctgtactccttacctccccctttagtagtcctcagtgtctattattttcatctttatatccatatgtaccccatgcttagctctcacttataagtgggaacatgtggtatttggttttctgtttctacattgattcacttaggataatagtctccagctgcatccatgttgctgcaaagaacatgatttaattctctttttatggctgcatagtattccatgctatatacataccacattttctttatctaatccacctttgatgggcacctacgttgattccatatgtttgctattgtgagtagtgctgcgatgaacatgtgagtgcatgtgcctttttggtagaacaatttatattcctttgggtatatacctaataatgagattgctgggtcgcatgatagttccatttttacttctttgagaaaactccaaatttcttttcacagtggcttaactaatttacattcccaccaacagtgcataagtgctcctttttctccaacatctcttattttttgactttttaataatagccattctgactggtgtgagatggtatctcatcgtggttttgattggcatttatctgatgattagtaatgcagagctctttttcgtatgctttttggccacttgtatgtcttcttttgagaagtgtctgttcatgcattttgcctactttttaatggggttatttggtttttgcttgttgaattaagttccttgtagattctggatattagacctttgtcagaggcatagtttgcaaatattttctcccattttgtaggctgtgtgtttactttcttgatagtttcttttgctgtgtagaagctctttagtttaattaggtcctacctggcaatttttgtttttgtttcaattgcttttgaaaacttaaagacatgtgtttgcatgtaactgttttgttagtatgctggacataaaatgttaatccaggttctaagcacagttctttcaaataaaatatattggcacaaactcatggaattaactttctttagaatataaccaactctttgtaaatcaataaaaggtttatttaatcctcccccaaaatcttgtgaaaagagatgagtaatcttttctaattcagtgttttaaagtatgggtttataaagccaatcaccaaggttgagattctgaaaatgtcttggctctctctcactagtgtcgattctaccatattaaattaaattcatttattcacttgcacatattcaacaagtgtactactcaattgggcagaacattgcagggttgctcactaaagtgctggattctacaatgatgggaatgttctagagctgctttaatacactagtcactagccacatgtgggtactgaacacttgaaatatagctaatgagacttgggaatcagattttaaaattctatttaattaatttttttttttttgagacggagtctcgctctgtcgcccaggctggagtgcagtggtgcgatcttggctcactgcaacccctgccttccgggtttaagcgattcacctgcctcagtctcccaagtagctgggattacaggtgcgtgccaccttgcctggctaattttttgcatttttagtagagatggggtttcaccgtgttagccaggatggtctcgatctcctgacctcatgatccacctgcctcggcctcccaaagtgctgggattacaggcataagaattctatttaattttaattgctttaaatataaatgcaagtagccacatgcagacagcacaacgctagaatcttgtcatatttgctcttatagaacccacttttcttccaagtggaggccatgtaagaagagtcagtatctagaacggagggtgaagggcgggatgtactccaaggaggagcaagactgcagaaagaaggttggaggcaaatggggaaagtgccacaattttggcttagggtgcttcttcctgtgtaactactctttttccgctgcatcacaggctcctcattctccacattgcagataatcacgtttaggactgctattggattggtgcatcagttgggcaagtaatctactgtttgcaaagtcagtgcagtgacccaccacaaagagccctgtcattttagtctttgaatctaatggctgtaacacactggtgctgaatctcttcctcttgtgacccaggccacccattttaaatgactggctggtggcaagtagataaggtttaggaccaggaatacagtcttctctgaatgagcatgggtgcctttatttatggagagaaactgtaactttccattcatgcctgcaaatctttatcttaggcctgctatgtgccaggcaagttgttaggcactagtatcagaaagaaaacccaagacctccacccctcagaatctgacttggtccttgttggtaatgagccttgcataagacttttaaaaaatgattgtgggcaaggcatagtggtgcacacctgtggtaccagcttctcgggaggctgagactggaggattgcttgagcccaggaggtggaggatacagtgaatgagctataattgaacttcagcctgggcaacagagtgagactccatctctatctcaaaaaaaaaaaagtttgttgacatgagatagcctcaccaaagcatttgagatttcttttgagttacaactttaatgtatttcttcaactgggcgcctattgtatgccagacacagtgctaggcactgagaattcaaaggcacttttccttgcccagaaaatccaggctcaggaggaagacagtcatgcaaactggtaattgcacaatgtattgagttctaggctattatagaaacaccaagtagggctccagactcacatccaatatgattcctgttacattgataagtgtattcaatgacacttatttgaaagtttctgtaatgaaatctgaagaagttcactcttataacaagatctttgctttgcactagactatcaacatcactgccaaagacactgtaattaactagtaacatacaagctcagtcaatatgaggtaacaagatagaagggtatgaattaagcagccccaacaatccagcacagtgattagcacatatcaggcacacagtcagtaatcaccagagttttggttttatgttgctttgttttgtttcacaagttcagtgtggcttgggttattaaagagaaggtaacattttgtattttgatacagacagtggtagccaactcttgattgcttctcccctccacaccccccacccaatcccagcatcatgctaaacactgcttttattttatttttaattgtagatatttaaggtgtacctcataatgttttgatacacatgtacatagtgaaatgatcttgtggtcaagcaaattaacatacccatttcctcacatggtcatctcctgtgtgtggtaagagcacctgattgcttctagattgattatcccaggaaatgcttcccagtctcttagtgtgtaacatctttgtgaatttgcaaggacaggcttcctatattttgctggccttccactgaggcattctaagtctagccgccctcaccgtcagcaccccatcctacacgggatgcatcagcccttcattctagcccacttctgtggaaaggataggctgttagcaatgcattgaattcttgtggtctccttgcttttgttcatctatgaaccatttctactttcccttgaatatttacatctaatttatctcaatttatgttttcaatggcagaagctgtacttgtttttctaaattacagaaataaatataatgaccataaaactttcaaaaactgaaagtatgtgaaaaatgtttctcttctattgttcctccccctagagggccactgttaaaaatttagattgtttatccttaaagatttactgtatgcataggtaatacaagttgaacatccctaatctgaaaactcaaaattcaaaatgctccaaattctgaaacttttgaagcatcgacatgatgtctgaagtagaaaattccatatctgacctcatgtgatgggtcacagtcaaaactttgtttcatgtacaaaattattaaaatatgtataaaattaccttcagactatgtgtataagatgtatttgaaacataaatgaatctggtatttgggcttgggtctcacactcaaatctcattatgtatatgcaagaattccaaaatctgaaaagagccaaaatttgaaacacttcttgtctcaaacatttcatataagggataaggatactcaacctgtactttaaatatatgtgtgtgagcatccctatatatatgtagagagaactatatatactggaaatacatgttaaataatataataaatattttatacaaatataactttaattttaaataaatatgttaatatatttttccaaaaacatgttttttaaaaaacatacatcatacatatcacactgaaatttgctttttcctgttaacaatatgccatggacatctctccatagcagtacatttaaatctaacccctttcgacaactgaataaacagtatctcattgtgtgccttatcagaatttacccaagacatcagctgttgatagtcatttttcttgtttccatgtttttgctattatacaccatgctgcaataaacagcatcctccatatagctctacatatttgtataggagcatttctttttgataaatgctgtaggatggaattatcaagtcaattgatttgggtagacctgtgaaatttttgttagggtctgtcctctcacatccttgtcagttgatataagttccatatctgtcttctccaaatctcatgttgaaatttgatccccagtgttggaggtggggcctaaaagcaaatgtttgggtcatgtggacagatccctcctgaacatcttggtgccgtcctcctccctgaggtaataaatgagttcttgctctgtcagttcccatgagagctggttgttaaaaagagcctggcacttccctcccctctctcttgcctcccgtctcaccaagtgatctgcacacgccagctcctcttcaccttcagccatgagtggaagcttcctgaggccctcatgagaagcagatgctggcaccatgtttcttgtacagcctgtagaaccatgagccaagtaaatatcttctttccttcatatattacccagcctcaggtatccctttatagcaacaccagcagtctaagacaccagctaataatatttaaaatttttttgtcaatcaggtaggagaaattgcctcatttatctataatttgtaatttttatcattaacaaagtatcattttgtaaattacctttgctcattaaagtttttttctgtttatattgcaaatattttctcccagtgaatcagtttttaacgatttgttgtatgatggtttccccctactaaattctcagatacacattgattctttctgttccactgacctttttcactgcgttctaaacatttttgcagctctacttattaaaaaatgtacacataaactatcactataggtattcctaaattgtacacaagtacctctgaaaaattatatcgttgtaactataaaacatttgaaaagtagactttttaaaaagcttaaattgaaaaaccagaatctctagtattttcttccactatctagatgtgcaatctaggtgtacacccccactttggaaagcacaagtttatattatctaatcctatggcagcattgtactgttttaatatctgtagctttatgatatgtttataatatgttatatattatgtcaggtaggacattcccttattattatttttcctttaattttgtccttggtaaacttcttcagttattcatccagatgaatgttattatcatctcatcaaagctcctgcctccacacccctacattacaaaagcttctattgacttattttattctgaacatgcctctttgttacctcccagagctacaatggcttcttttctctctgagaaagttagcactttgggggaaatttcttctactacctgaattattgggtccctccccctacccacccccccatagtttttctgtttcatttgttagttgtgaatttgtttcttctttgtctttgcatttattctttaagaacttctttaagtgtttggatgtccttgaatatcatctctttttctaagagtaaagccctacaaagctgatgagatgttttgtgtgcatgggtggggctcttgagctttctatctgcaagtggcagaaatctcttccatgctgcatagcttgtcctggcatgaacatgacttttctctctgctccttgttccttcacctccattaagtgcactcacttgactcagaggccagattcactctgagaaggaagtgtccaaggagcccctacatcgagaaagcagtacttccaccttggccagcctggcatcctatgctggtcctgtccaaccgatccccacatgatcagtatgcacacgttctttgatcagatcttgtcctatttgtctgctctctctcttgccttcttatattaggggattcctaagatggttctcttgtatttttaaaccttgagctcttagactttaaacatttcttcttcacatacttcagactttctcaacatcttttcctgccccagcatgcctgaaggacattcaaacacccctcaagccagtggcagattgggacattgattctaacaggtgcacagtggggaggggtgcaggagacgagaaagagacaagttccctttaaaaggcttcctggtttgtctgcttacacacacgtatgcacacatgttggggaggtcctttctctgttctttcttccttattttgaaatcttcttgttgggttttctatacaacatttgccgctgagtcttccacaataattttgttcaaacaacctcaattttgcaagtaaatgatggagcagaaggagttggacactgcagtaatatattgttataacatttcagactctgccctgatattttcaccagtgccctgtcacagtcttttgaaattgcatatacaggcacacctctttttattgaacttcactttattgcactttacagataattgcactttttacaaattgaaggtttgtggcaaccctgcactgagcaggtttatcggcatcatttttccaacagcgtgtactcactttatgtctctgtgtcatattttggtaattctaacaatatttcaaactttcattattattatgtttgtcatggtgatctgtgatcagtggcccttgatgttactattgtaattgtttaggagttccataaacagcacccatataagatggcaaacttaatcgataaatgctgtatgtattctgactgctcagtcaaccaactgttcccccagatctccccatcttcttgggtatctctgttccctgggacacaacagtaatgaaataaggccaatgaatgaccctacagtggtctccccagtgttcaagtgaaagaaagtgctgcacatctcttgctttaaatcaaaaactagaaatgattaagcttagtgaggaaggcatattgaaagctgagataggctgaaagctaggcctcttgtgccaaatacccaagttgtaaatgcaaaataaaaattcttgaaggaaattaaaagtgcactccagtgaacatatgaatgataagaaagtgaaacagccttattgctgatacagagaactgaatgatctgaatagaagatcaaaccagccacaatattcctttaagccaaagcctagatccagagcaaggcccccaactctcttcaattgaagttgaagctgcagaagaaaagtgtgaagctagcagaggttggttcatgaagtttaaggaaagaagcctcctccccataacataaaagtgcaaggtgaagcagcaagggctgatgaagaagctgcagcaagttatccagaagttctacgtaagaacattgacaaaggtggctacattaaacaacagattgtcttgttttgttttgttttgagatggagtctcactctttcacccaggctggagcgcagtggcgcgatctcggctcacggcaacttccggctccctggttcaagtgattctcctgcctcagcctcccgtgtagctggggttacagtcacacaccaccatgcccatctaatatttgtatttttagtagagacggggtttcaccatgttggccaggctggtcttgaactcctgacctcaagtgatccgcccatcttggcctcccaaagggctaggattacaggcaagagccaccacacccgaccggaaacaacaggtttttaatatagaccaaacagcattatattggaagaaaatgccatctaggactttcatagctacagaaaggaagtcagcacctggcttcaaagcttcaaaggacaggctgtctctattgttaggagttaatgcagctggtgactttaagttgaagtcaatgtccatttaccattcaggaaatcctaagacccttaggaattatgctaagactactctgcctgtgctctataaatgctatcaaacagcaacaaagtctgaatgacagcctatttatttatagcatggtttactgaatattttaagcccactcttgagacctactgctgagaagaaaaaagatttctcaaaatgttactgttcatggacaatgcacctggtcacccaagggctctgatggagatgtgcaaggagattattgttgttttcatgcctgctaacacaatgtccattctgcagcccatggatcaaggagtaatttcaactttcaagtcttattatttaagaaatacattttgtaaagctatacctgccttacagtcctcctgcctatctgatggatctaggcaaagtaaattgaaaaccttctggaaagagttcactattgtcaatgccatgaaaaacattcgtgattcatggaaggatgtcaatacatcaacattaacaggagtttggaagaagttgattccaatcctcatgagtgactttgagggattcagtggaggaagtaactgcagatatggtggaaatagcaagagaattagaatcataagtggaacctgaagatgtgagtgaattgctgccaactcatgataaaacttaaatagatggggagttgcttcttatggatgtgcaaagaacgtgatttcttgagatggaaactcctcctggtgaagatgctgtgaacattgttgaaatgacaagaagggatttagaatattacataaacttagttgataaagcagtgacagggttggagaggattgactccaattttgaaagaagttctaccatgggtaaaatgctatcaaacagcatcgcagccttcagagaaatttttcataaaaaaaggagtcaattgatgtggcaaacttcgttgttgtcttcttttttaaaattgccacagccacaccaaccttcagcagccaccaccctgatcagtcagcagccatcaacattgaagcaagcccctccaccagcaacaagattacaactcactaaaggctcagatgattgttagcttttttagtaataaagtatgcttaaattatgtacatattttagatataattctattgcacatttaatagactacagtgtagtgtagatataacttttatatgcactgggaaaccaagcaatttacgtgacacaatttgctttattacaatattcactttatttccattatctgaaatgaaacccacattatctttgaggtgtgcctgtattttgttcaggagggaactgaggaagacactcttatccaggatgagctgaaattgtttctcaagttgttcttgacaggggaaagagtctttggaggtcatgtttgaaatgagggtttgggactctatgaatttcaattatacatgtcctctctgctctgcctccagataataaatatacaatcatgtcatctgcaaacagagacaatttgacttcctctcttcctatttgaatatcctttatttctttctcttgcctgattgccctgtccagaacttccaatactatgttgaataggagtggtgagagagggcatccttgtcttgtgctggttttcaaagagaatgcttccggcttttgcccattcagtatgatattggctgtgggtttgtcctaaatagctcttattattttgagatacgttccatcaatacctagtttatggagagtttttagtatgaagggctgttgagttttatcgaaggccttttctgcatctattgaggtaatcatgtggttttggtcattggttctgtttacgtgacggattacgtttattgatttgcatatgttgaaccagccttccatcccagggaggaagccgacttgatcatagtggataagctttttgaggtgctgctagattcagtttgctagtattttattgaggatttttgcatcgatgttcatcagggatattggtctaaaattgtctttttttgttgcgtctctgccaggctttggtatcaggattatgctggcctcataaaatgagttagggaggagtccctctttttctattgcttggaatagtttcagaatgaatggtaccagctcctctttgtacctctggtagaatttggctgtgaatccgtctggtcttgggctttttttggttggtagactattaattactgcctcaatttcaaaacttgttcttgttctattcaggggttcgatttcttcctagtttagtcttgggagggtgtatgtgtccaggaatttatccatttcttctagattttctagtttatttgcctagaggtgtttatagtatagtactctctgttggtagtttgtatttctgtgggattagtggtaatatcccctttatcattttttattgcatctatttgattcttctttcttttcttctttattagtctggctagcggtctatttttttgatcttttcaaaaaaccggctcctggattcattgatttttttgaagggatttttgtgtctctgtctccttcagttctgctctgatcttagttatttcttgtcttctgctagcttttgaatttgtttgctcttgcttctctagttcatttaattgtgatgttagggtgttgattttagatcttccctgctttctcttatgggcatttagtgctataaatttccctctaaacactgcctccagataataaagaactacttagaataagtgacttttcataaagtgtcagtgttcagtctcttcttttttacagtaatgaactggtatttcctttacacatctttggatttattctgatttcttatgaaagagaaaacagggagcccaagtattaactgcaaggagaaccagatttcattaaacggtgacctggatgaattcctaatatcatatgctttattctttgcagagaagggcttatggtttgattttttcaaaaaatgctggctacttatccctcctttgacatcagtttggtttgccttcatatgtttggagtataacatgctttatttggcctttgggcttctcaagtttaaaaacatgcacttcattatatctgtaatggatattttgatagagtgatgaatatgctcttccattttgctgttctctaagattactgtggaaccatgattattgatggagaagaagctccagttgcctacacgttggatgataccaaacctgaaggcaactatgctgccataatggggtaaggcacaattatggtgttgtggctgctattcagtgttgacaagataatcacatactattaacaaatgtgccccaaactttgttaagtgattttttttttacccagtggtattatttttcaaattcagcggtacaaaaattattactggttcttttctaaataatgtcttccaatgaataaatatctaggtaggaagcagaataccaataacattttaaaatttttatgttagttttctattagtatttagtgttgggggtagacatatttaggtgacccatcttttgttgaaagcatgataaaaagacctgacttggggtgttttactaagagacttcttgtggaggctgtgtgggcatccatgttacttaaatgagatgctgagatttctgagtcccagtagagaagagccaagaccagcccagtcttcagctttccagggacgaccagcacgtgggaagggaagaccaggatatcctggcccagagaggtggtgacctggagtatccaaaattaagatgggcctcaggacatgtatgagtttatctcagagagagccaacagtcagaacagagagatcaaagctaattgttagttgaaagcaatcatggggctagaaatggagatggaatctagaaggttgggtgctagggagacaccatggtggagacaaaaccaaagagcaaggactggatgaaattggaagagctcagacatagccttaagtgggcatctgaggcccaagggttattcttattgaccaccagctgggtgaggggaagtgggtcagccatagtgttatccaaggcaaaaattatggccagtcatctacttttagtcgcttgattccttgaagttagaaagtgctcttcagtgtcagaaatttgatatgtaaatcataaaactttgaacgtaagaaaagctagtgtatagtttgtttcttttggttgacttaactgtgtaaactgggcacatgtgtagctacgaaaatgaggctaggatgaaaccaaccattaatttctcccctttttcttgtttatattctttagatttatcctggcccacaaagccagaaaactggcacgtcttaccaaagaggaaaggtaacaaaagaaatgctgcttctttcgtttcttccttcctttcccccccactccatccctccctcccttttctctttctttccttcttttctacctacttgcctgcctttcatttttacttaactttttaacttacggactgcctaattatatgtgtattgccagtgctacgtgtttgctatgttaattataagggtcttgttgtaaaagacatagtgctgataacttaagaaccaaagtattcaaattaatatttattgagtttattgtacataagacaccatgctaggggctacggagaatatgaaaatggatataacccaggggctgaaaatttgcttgtgaaggagataaaccagggagaaaaattactgtgttgtggggaagtctgctgtacacatactacatgaatgatgcataacaattacagattataggtacagtgggactaattcctctggaggtggcaatttcttcttgcaattagtgttcaccagtgccaattatttattcccacaccactgctaataacctatttaccaggaaagagctcctgaattatattatgatgcatgctttccgattccatcagggttctcctcaatgaccaatgttacctctgcacatagccagggccgtagcggtctgcctcggcctcttccctaaaaatgtccccactagaatataagatcatgaaggtaggatgttttgtctgattggctcactgctgggtttccagtgtctggaacaaatcttttcccactttgccttttgatcctgtttatggcttattcattttatactataataaaattttatctttttatgtaatcaaatttatccattttaaaaccatggtttctgagtatctatcatacatagaaaagactttctcattccaagataattttttagaaatcacccattcttccactcgttttatggtctgacctattatatgtaaatctttgatccttctgaaacatattttggtgtaagaaaataacgtaagcatcctactttatttctttcacgagcagctatttgtcccagtgccattttattgaaaactgtcttttccctgtgggttcaaaatgtccacctttatgaattctaaatttccttatatatttggttctacttctgtacttatttctttgctctttctatccattcctctgcttgtggcaagttacatcatttgtataaaaacaaagaaaaagacagaaagagagagaaagaagagagggagggagaagaacttaggcattttcataaacatttgtttcagaaacattttgttcataaacaaaagggctcctggatttaaaataataaaataataccatgattcaggcaacatgtcactttactttcttaaagacttaccagcaatcctgtgtgattaatatttgtgacctcaaagatttaagacatctgaaatggaacaaaatgccttgttttaaaaaattaaaatgaaatgctggagtggaatcaatggctcatggaatcttttttatgaggggataaatgcctctttcccactttttttttccctcccttctttcctttattttctcttttgtctcttttcattcacaggttgaagaaactttgtgaactctatgccaaggttctgggttccctagaagctctggaggtaaggctgcttcccaaccctatactaagggtgagaggcctttctttgtccccaagtgactagcagggataggttaatgcaagttgggtcctgaagttcatgtttttcccaatatatttgcagaggcatctacacaggactggtcagtttacaagtggttccagagagtgtgggccctggctgtgctggtggcaggtcagggaacttgcaatatgctgtggtttaggtgatgctacattgtccctgaattcagagtttcttcctgggagagggcattgggtcactctgcttccagttctgttaggggggtaaaagaggggagcttctactacccataggaagatcctagatcctggtagccaggatggggatgaaaagggctttttcccctctctggtgatcttgtaagaaggacagagtctcactcaggtacataaacctatacctaccccatcccccactgtctcacagtaaaaaaataagattacctgtccccactcctgcatgccctcttttctgccttgttttacccttgaacatgagagatgtaaagaagacaggctgtctgtctgtatgccagttgagttttctagacacctttggaagtagcctgagaaaacggtgatcttcaaatgaatcaagtagaactctaaggtggttaaaggtgggataggggcagggtagggggcatttggtgacagtcagagggcccaaagtactcataacaagtacccataatcacctccctcatcaatatttaaaatgatgaattggtgttctcatgacattcatcagactgctaagtttttaatgttttgacatagactatgtcaccttttgaaagtgattattaaatccaattatctgtgaagcatttgaagacaatggagaccaatgtacaaatgagcagttaatgcgtgagaaaagtctaatgaggaggctgagaatgtttaacttgttaagcctcttaaatccaagtctctgtagtatataccacaatctagttgagcagctacatgacttagtcctattactctaacacttactttgctcagctttggagtgacttgcttcctcctggttaagttgttgtgtctttcaaatttgtcatttttgttcactattttaaagcaaaattctctccctccctcctcgccccaccattgcagatcttctgtacttgatacaggtgaaacacatgctcttgatgtttcttggaattctttctcagcaaataaactagaacaattagagaaacaatattaatgaggaatatgttttgctttttttttttgctttcatataccaattagcaagtttaaatataggcatagcctccaggctcaaggatattgagtaaagtatcaagacaaaaaatacagtatatactcactaaaaacagaacttaacatctgttaaaaattattagtttttctgtttaaaaatgccattcagcatgatttataatcctttgggtatatacccagtaatgggattgctgggtcaaatgatatttctagttctagatccctgaggaatcgccacactgacttccacagtggttgaactagtttacagtcccaccaacagtgtaaaagacatatgcacacgtatgtttattgcggcactattcacaatagcaaagacttgaaaccaacccaaatgtccaacaatgatagactggattaagaaaatgtggcacatatacaccatggaatactatgcagccataaaaatgatgagttcatgtcctttgtagggacatggatgaagctggaaaccgtcattctcagcaaactatcgcagggacaaaaaaccaaacactgcatgttctcactcataggtgggaattgaacaatgagaacacatggacacaggaaggggaacatcacacactgggacctgttgtggggtggggggaggggggagggatagcatttggagatatacctaatgttaaatgacgagttactgggtgcagcacaccaacatggcacatgtatacatatgtaactaacctgcacgttgtgcacatgtaccctaaaacttaaagtataataaaaaaaaatgccattcagtgctagaggtctggagaataaagagtgtggagttgatttaaaaaaaaaagccattcaagatatttcaccctggtagatattcaagctttgtgaagttacattctgaggcactcccaggctaaagcagtttgttaattgaagttcctgcaacaactcgtgagatggttgtttggggaacttcagttgaaggggaaagcatttgtcctcatattttgaaaaaggctgatcatttttcatttgagaaagtctcttttcctaagaagggtgtgcatgattaattcctgatgataaaaataagttggtcctgtccttgtttgctcttggcatagagaaggccacttgttttctttttgctttggtgtctattttgtggaaggaagaaattcctgggaacaagatacattgaaagataaagtccaacttttcttctgattggctggagacagccagagaagcttgcttaggaggtggatgtagccgtcaggtgctggggcgtgtagcgtggtgataccacagaagacctggagccacttaacccatcaggcagaacctcataatcatactttgtaaataggatgccttacaaatgactgtccaaagtcagctgtgtgattgcaattcttttaaacaaaatgtttttcaaaatctccctttaaaacaaacattgttttcttaaaacttgctacgttgattttatcttttcgaagtaatgcttaatgataaagcttctgtttggttactttaaaaaagcatttgagctttacaaaatctctgccaatttttcctgttcgtgtcaaaaacatatttttcagaccaatagttgtttacaaataccaccatcaacagaagtgcttgcctgccacaaaaacatgtttgttcagcctccctcaagaaagctcacctccaccaaaacatgaacctgataatcctttttcttcaacagacatatttttctgtctttttttcctatccagtcactccagtaaacataaatccttttaaaaacttttcttgaaaccatcaggcactaaaactttttaataggtaaaaccaaggtaaaaatggaattagattatcgcaatttatgaacagtacttaagatacaaagaaaccaaatgaaaaaaacattctaagatctgaatttcttagaagcttattaccaaggacatttacctgcccaaagacatatctttaaaaacatcaggataatgcaactctatttccgaaatacattggtttgacaatacaaagcctactaaactgttcgatttattctaggctaaatagctttctctgagtctccttcaagtttttgttgctctatcttgcagccagtgcattatgaagaaaagaactggtgtgaggagcagtactctgggggctgctacacaacttatttcccccctgggatcctgactcaatatggaaggtagagtaaaagcatgctaagctgttacagaaatcccctgcacctgaatccaaaacctaaataggttcaggtagctcttctcccttgtttcttataaatacaaaaaaaaaaaaaaaaaacaacccaatttcctttgtatcttatgaatgaaatcgtgtatcttatgaatgaaatcattataattatacatacatcatggtgctgcttttccctggaagagcaattccaatcaatataaccatagaaggtttcagcataagaatagcattttaccccattcttcatgatatgattattacgcattgcatgcctgtatcaaaacacatcatgtacccatagatatatacacctactctgtacccataaaaattaaaaatcaaaaaagagtagcattttaggtagtccaagggttcacccaatgtcagaagaagtgtccttatactgagttaggactcagtaaaacttcctcaaatgccactgtacaactgccaacacggggacaaaattataaaaacaaaatgagttctagactgggcatgaagagacttgggtcccagctctgattctaccaataacaaactttgtcatgccaaacaggtcacttctcctttctgaacctcactttcttagcaagtggatgggaaagcacaaaatgatgaaaagtgagcaataatcagtatgctcaagaaagtatgagttttttttattttttgatcctaatccttagatgctgggaagtatgagttattttttaacatccttattgagacgtaattcacataccatacaattcacctattcaaaacggtgcacagttcaatggcttttagcattcacagcattatacatccaagtgtgttgttgtttagttaatttatttgatgacaataaatgaactaataatatagcagtgatttttatgactattatactattactaaaccaagcaataatttaatgccaaaagcttaatctaaacaggatgagaaatgtagactagtgagtcaaagactgttgaaagtatgcagcaaacagagggggtaagtggaaatggctaatcaatctgtccatgaaaactggtcgaataaggagtaaaacctgcttatcagaagatacgtaataactttggttagcactttctttacctgcttaaagatggcaaaatattatccaagagaacattctggggccaaggggcagcacctgataagctgctgggtcattaagttaatttttagatatgctgactgtgttactctattttcacactgctgataaagacatacctgagaccgggcaatttacaaaagtaagaggtttattggacttacagttctacatggctggggaggcttcacaatcatggcaaaaggcaaggaggagcaagtcacatcttacgtcgatggcagcaggcaaagagagagcttgtgcaaagaaactcccgtttttaaaaccatcagatcttgtgagatccattcattatcaccagaacagcacaggaaagacccccgcccataattcactcatctcccactgggtccctcccacaacacatgagaattatgggagctacaatatgagatttgagtggggacacagagccaaatcgtatcactgagtgtagaatatgtcaatggtatttgtttcattctgcatttattggctaagtgccaaccatttgcgaagcactgtgctgagaacttcaataccaaggacagcctccctgctgagaaggagctgacagtgttgagggctagggtggggatggggagaggacatgatatcaaaaattgactctaaagtactgacatatgtccctggaagggaataaggataaaggagggcactactgtatcaccactcagaatgttaccactgaggtaaatgctctaatacaggggcatagagataccactggaacacacagaggcacaggctagctttacttagagaaatctgggaaggcttcataatgcacataccacctgagggttgtaggaggcagagaaaggctattggggatgcagtctatgcagatggaatggcatgaggaaaacgctaggatcccacaggtttctggaaagtctggggaagaactttgcatggatggtgtattaggccattcttgcattgcttaaaataaatacctgagtctggggaacttataaagaaaaaaggtttaattggctcatagttctgcaggctatacaagcatggtgctggcatctgctcagtttctggtgaagcctcagggagctcacaatcatggcagaaggcaaagtgagaacaggcaagtcacatggcgaaagcaggaacaagcaagtgtggtggggagaggtaccatacactcttaacgtgaccagatcttgctagaactcactatcatgaagaaggcaccaagccatgagggatccgtccccatgatccaaacacctcccaccaggccccacctcaagcattggaaattacaattctacatgagatttgggcagggacaaatatcaaaatattatatcagatgggctatgggtgatattaaggacagaatggagaatcagatcaaagggggaggaagaacagtttgccctatatgacacattcaggaatacaaaacttgatatttcaacagagaacagctatcactgcattacttttgtttttggctttgttttaaatcagaagtgtgatatgattagatttctgaccacagagtggtgggttttatgctcaatttcataaataccttttggtttggggaacaaagaggacactaacctgaactggcctgatcctgaccacgtgagagaagcaagataaatcccattgtatctggcattggtggtgatacagtaatgccttcttttatctttattccttcccagggatatatgtcaggcttcctataactaccttcaatttttagggtagaaactaaggcacagcatagcttaacataattcccagcttgaacagagactacctgcccagaagacttcccttgacccttcagggccatggtatttaagatattgcaataagttttatattcagagccctgaaagttcacagtacatgttctgaaggaaaagagaagacagaattaccagtacaacttggtaaagaactaaatatacatttcttaagaaatgtttcttctggatagggtgaaaaaaatgattgtcgtgattatgcagtaaaactcataagccacaagaaatatatgtggagttcccctttatgatgtcctatatcttttgtaaatatatactgtctgttcacgcacctgcaaaagaaggggcaggtatttttcttacctggttgttggactctttttttcccttaaaggaacataatttccaaatgacaagtggcgggaaactatctctttgtttaaaattaattcttggttttcacatattctgatttatagtatgattagttctctaagcctttgttctgtcttctaatatttcattcttagggtctagccaggcctcctagaggtctccagctggggttagttttctccattgaaaaaaaagtaaacatgtagtgaaaaacggcattgtttaatcaacacggggaaagtcaatccaccttctcttgtaggaagggttccttcctgagtacccttaggctctctatatatttcatgtgttgtcatcaatatactaatacaggtgttcctcaaaatatgatggggttatatcccaataaacccaccataaattgaaaatattataagtggaaaatgcgcttaatacacctaatgtactgaatatcatagtttagcttagctaccttaaacgtgctcagaacacttatattagccgacagttgggcataatcatctaacagaaagcgtattttataatagagggttgaatatttcatgtcaagttttaaatacggtattgaaagtgaaagacagaatggttgtatgggtacttgaagtatggtttctactgaatgtgtattgttttaacaccatcataaagttaacaattatacgttggagaccatctgtattctatataatatctctccttgtattttcttctcctttttgtgatgactacaatcagagcaggtgaaagaaaacccaccaatgcaagccagctcatttggttttctaataaaaggcccagtggtgtacagtgttgactaagatggaacatggatgttagttcttgacatcgcttatcagatataagagaaccatgagacaggatgaataatggcatgttgacggtgctttccttatggtatttttgtcagagcaacaatgaactgcccctcttacaggccaagtgctatgacatttcagtcccttgtatagcatgtgggcagtctactaactattaaatattatagggtgatgatacaccaggcaaagaatataagataaaaatagagactttgacatctgttagacatggttcaaatcctggctttgctattttctaggagtgtggctcttggcatatcactgaacatttctccaagcctcagtcttctcatatgtaaaaatgagataatgataatagtagctacatcacagagttctttaatagattgaagaaataatgcagtagagagaggaagtataactaagtggttaagactgtaggttccagagtcagattgcctgtgttcaaataccaactctgctacttactagctgtgaccgagagcaaattactttgtctttgttgctggttaggttccaggaagcagaccctgaaacaacgattagcagacaggatatatattaaggcatgcccttaggattggcagctgtggaagggagaaggaagcaggagtgggcatagggagaacttgggctgcagtgcagttccagtgaaggcctcagctgaccccagaggaagttccagaactagaatggcccttcagagtgggaggtctcaagttggagcttgggaatcaggtatttacagcccgtggtgatcagtcactggatgcaactgctattggaaggaggcatgacctagtaggtaacatagttttttttagcagaggcaatctccaaagagggctgacatcagtaggccctcttctggcagcactcccagcagctgggaataagtctttcattcttgaagggggcctgcgtggttcatcacaatgtccaccacagtctacctccatattcttatctgcaaaatggtgataataatagtaccgacctcaccagtacaggcaagtgttcaaggaataggagttatggagccatagtcagactctcagatttgttaaatgttactgattgaaagggtcttagaaatcagtggaccattccctttaagaggcaaggaagccagagcacagtgagagtaagtgatttgccaagttcactagtggaatagccagtggggaattgggggcatgtatcaccttgccacagagccagtgagccataaagggagccatgtgactgggcttacacagtccctcacttcatgttgatgaagcaaatacataatttacgtccattaatgtcagctccttcacctgcaactcttggtgcaggagtgaactttggcttttattctattttgtttgtgacaaggatcatgtaagagctggaggaaccacataaacattattccaaaattgccaatgtccttcttgattgtttagaatctgtggaagctgaccagcattggtctttatgggaaaacttttctctgactctctgagactgaccacttttgcctctttggttttgttccaagggttctacgccagccagtggacaggatttactttgcaggcaccgagactgccacacactggagcggctacatggagggggctgtagaggccggggagagagcagcccgagaggtagggtctggggtcatagattatggggaaggaggcaactcatggtcctgacatgtaggtcaaagatatctgagagcctggagaccaactctccagtaacccccatcttaagacccataaaatactattttaactattgtctcaggtgaagtgaacaccttagcccgaagtaataatgaaaatacctaacatgtcacccgaagtaaaaagagcccatggggcaaacgatcaacctgactatacttgaaaggtaacctaggtctgatattctagaaccaaacatgcttctattaggactcaaaattcaattcatttcacaggaaagattttctgacagttcctctgatgtcatccctatttgaggtgtgttcataactattaaaatttatggtaagcctaatgattggaacctcttataccacaggagaaagaccttttggcgcctcttaaaggttgtatggagtgttctggcctttaccttggtgtttttgatggatatctcaagagacagttacttagtcctttagggagcagattagaagaaagatggtgtcacttttgctatttgccagtgtgttctttcatttcagatcctgcatgccatggggaagattccagaggatgaaatctggcagtcagaaccagagtctgtggtaggctatgttttatttcatgaaattagatatcttttctctaaacccattattttcaagaagagcacacttgtatatattcacataccttttcctaagtgattcaactaagtgatttaaacatgaatgtttaaataagtatcatgggttagggtagaggtgagagatttagatgaactttgataaatttgtagctgtcacattcattacagattattaggaaaaaatattttttgatgaggagggagacatttctcggagacttctaaaaataataactcaataaatgcctgtcaaataaatatctagcctggtgattctccacatgaggtaggaaaagaaaggaaagtgtgttagcatctcctgtccagggacaaacaaatggaatgaaatggagaatatttagattaaaattttatttttaatatactcatcatttttgtaataaaatcctaggaagttttcctggctggaaggagggatgcatagaggttagagtgcaaacgcactttagaggacaaagtcacaaaggtcagaattattgctctatccttttaagtgtgaagtcaaagagaataggcctgccactccacagtcattctcttagtgcttctgccagggatgggattgtgggctgtagggaccattgattcatttactaacaagtatttatggcacacgtgttctgtatcagccattgtggcaaaggcacagcagcatttttgtggagctcaacatctggtggagaatgcagatgataaccaaaaagtacagaacagtgaagaagacatgctgagaaaaaatgcaaaaggagaatgtcatcctaggctggggtctcaggaaagaaagcctccctgaggaagtgaagggtccagtgaggaagacagggtaaacagtataagcagagggaacatcgtgtttactggtctagacgttggcaagaatgggtcatgttcagagagctggagaaagtacagactttctggaataaagtgcacaagccctgtactaatacccaatgttttctgaacctaggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccat

SEQ ID NO: 36525 - DNA, 131224 bp, Homo sapiens
gtcgctcgcgccgctgcgtgcggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtggcgcccgggcctccgctcgcgccccacgcacgacgccccgggccgctccgcgtccgggaccttcgcatccgttcagtgtctgcgcgccctcgctggttctggtccagctccgcgtgccccccggccccattcggccctcgccgccctggcctgtgccctcttggtgcccgcgtgcgtgttggttgcgggcgtcctctccctcgaggctgcggtgccgcgtggctcccggcctcggagaccaggccggactcttggagtgcaggggaggaggtggggcggcccgcgagtgcgggggaccgcgcgcacggagccgcggcgcgcggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaattattcagaaactatgtgatgggcttagggatcaatgggagcatcataggaattctttctcattttaaggttaatttttaaattagcggtttacttccagcaacagtctcgagttttcaaaaactgaaaattaaaaagactacttttcgcagttcttcaaattaaatgcatagcagaacatggtattttaagattcagagtctactttttataagggggagaggatagctatttgaaatattttgcatcttaaaaattaggtttatctaaagcttaaaatgcgactctatcaaaactaagttcaaagtattgtaattgactaatctttctattgtctctagggcaaattctattgcttctttttatatgtgctttacccaactctccttttctagcagttaaacaatgcagtggttctttaaagctagttcttttatctgcttgagaggttaaacaaacgaaagctgggtttgacctttcccaaaggcattctcattgtgtcctctccagctcccttctcccagggttctaatgacttcagtgtagtactcatttttcttcatcttgaaagattttcttagttggtattcacaaaagctgtgtcttttcacatgtttaaatattggaaagtttggtcaactattatatttaccttccaacctgtgcttattctagaactatgtacatatagaaattgttcttgcatttccagttggctgacatgaagttgcttaatagcatttgtttttaaaaaatctgtttgctttaaaatttacaacctaatagtcaatgatgtgcttcactatcttcaacaattacgaaaacaaaggtggaacacactttgctaagtggtcatgccaacattgtaacctcctatctcttgtcagtgtgtctttgtagtcacacgttacggttcccatagaaacctatgtatggcaggtaaccttttggttattgggatgttttgattaaaacaattgcgttataatgcaagtattaaatgaattgtccctactcacgggctagtactagtgatcgtctttggaattccaaggactttctttgaagagtactcccagattgtttttcactttgggtggctctccattgctgtagaccttgaatctctttttcttttcttttctttctttctttctttcttttttttttttttttttttttttttgagacggagtcttgctcttgtctcccagactggagtgcagtggtgtgatctcggctcactgcaacctccgcctcctgggttcaagcgattctcctgcctcagactcccgagtagctgggagtacaggcgcccgccaccatgcccggctaatttttgtacttttagtagagatgcagtttcaccatgttggacagattggtctcgaactcctgacctcaggttgatccgcccacctcggcctcccaaaatgctgggattacaggcgtgagccaccgctcccggccgaatctctcaacttctcttctcagtccgttttaagggccctgtttctttcaagtcaggctttttttggctttgctcttgggcatgtggaactaaatgcttctgacagccccacacattcttcttcagggctggttctttacctgtggcttgactttatgctggtaatacagaaatattttatgccagtaatacataaatgatgtacattataaaataaacaatatcaacacagagatttatagaggtaaaaagtcttaagttttctttttcccgtcttattgttgtcctattcctatttctttcttcagaggtaaccataatatagggtgtatccttctggattttttccatttaatactgtagatgaaatatataaccctgtatgttaaaaaaaccatttcatgaatgcctactaggtaccaggtactattttaatcactagggttgcaaaaataagagacagacgctttcaagatgttcatagtctaccaggacaagcaattacagtgcagtgtgataagtaccatgatagagtcagtaatcagtgagggatgtaggagcctcatgcatgacctaatccattcattcatttgctttattcattcagtacacttcagagttttaatatgtgccggggatacagagataaacaagacagatacctctgtcagcccccgatgagcttgctgtgcagttcagtctcaaagagttttaaccgttggttacaatgtattgtttgatatgggatctgaaaggggccagcaacaagagctcagaggaggaccataaacccaagcttagggacgttcagagagacaggaaagcctcccagaggaagcaccatgagaaggaattggtcgaagtctgggttgaggagagggtgtacagagagatggtcagggaggtgatgcactggagcaaccacaaacaccaggagttcagtccagtgggggtggttgtgggcaagggcagggaagtggcaagaagtgagggaggagaagtaaggagggactgtgccttgtggggtcttgtgattactgttgtgtggagttcggagacctctgtgggcaacaggaaatggttgaagaattgtaagcaaaagagggacacggtcaaatttgccctttggagaatggattagaagagggaaggcttgaagcagggaaatttgaggaggtagaattgctgggatttggtcattggccgtgtgtgtgtatgtggtggggggagttggggcagggaggagttcagggcagtgtccagctctggctgggtggttgggtgatggcactgtccttaggtggggacagagcagcatccattttggggaaaagattatgggtcacacttggctgggttaagtttcaggtgctgaggggacagtgtgttcagttggctgcactagggatccagataatcaggagttgtctggattagagagacgcatgtgagagttattagctgtcccagactgtctcaaacagtttgagagtttcccaaactatcagctaaggtgctacagcaaacagggagactgggggatgtttcacattgttgaggaaaacacatagttccgtctcttcaagcctgtggaaactactagctcaagatagttaaaaatgtctagattagattgcactccattccattcgatgacctcatgtttgtaaagaaggatttttggtggttgctgtagcacgtgaaaatcagtgtagaaaaggaaatgagggaggccattgtccagtctgactccaaggtttgagagaaattgtgcagtgctcaacaagtgtacacatactgtattagtaaatacttgtggttatctaagaatgaaataaaaatgccattttttctctctattaaagtgtacttttttcaagttggtaccaagttgttaggacattaagtacttacgtttttaacattttctttgctcaataagcatttgttttggcctgagactccaagggtgcggtgaacagagaaagttttggaactcctgcctttgcctgtgcagtatttgttaatggaagctgttggagtagatgaggtcatttgaggagtgtgtatagagtaagaaaaggagtggtgtggagtgagatctgaggcactcttgtgtttgaaagggaagcagataataggctcccacactgggactaagaaggatgggggtcatggtgtccgaggaaacctcagcaggcagggcgtgctcagctgctgcgagctgttagtaatacaggggacactagaggcaacagtgacatgacagggatgggagggggaggccagtttgtatcaggatttaatagtgagtgagagtgagggagtggagcccagcatgtgtagacagcaatgctcaagaaatttgatgctggtggttaggggtggttatagggagggcagataaagggggaaccctttggtttttgttttttaaatggggggatttgagcatgtttaaatgctggtaaagaaccaggagagggtaatttcagagtttccattggagttagcccactagatagcggtttcagagtttccattggagttagcctgaggacatgatgaatgatcttggtgaggagtctgtggaacctcattgctgtggattgcagagtgaagggtgttgagggagggaagctggttctttcccaaacttgattatgaagaggagagaatgacattaactggagaggggcatctggtgtaggctgatttcctcccctcccctcccctctcctcccctcctccctcccttccccttcgcctccctcccttttcttttcttttctcttttcttttcttttctttctagcagtgactttattttctcttttttttgctgttgtcttaagaacaccttttgtcttcctttctcaagacatgctcttctgaggactggttgttcctttgcagggcggttgcttcccaccctggacttttcctaggtgccattgtgtctccaggtcgtgatgtctttgtggctgactgtcctcctttgctgtcctgttctgacagaatactctctcctgtcagtgttttttctgctacttacctcagcaccagttttgtgtcagatcctatccgcctatcttcatagatgtttttatttttattttttgtagagatggtgttttgctatgttgcccaagctggtcttgaactcctgggctcaagcagtcctcccaccttggcctcccaaagtgttgcaccgcccccgatgtcatagatgtttatagattataataatttttccgcactaatgcctggtgtggtggctaacacctgtaatcccagcactttgggaggctgatcacctcaggtcaggagttcgagaacagcatggccaacatggcaaaaccctgtctctactaaaaatacaaaaattagccagttgtagtggcacacacctgtactcccagcttctagggagggtgaggcaggagaattgcttgaacccgggaggcagaggttgcagtgagctgagatcgtgccactgtactccagcctgggcaacagagtgagactccatctcaaaaaaaaaaaaaaaaaaaaaaaagaatagtttttccatacttagatttcagccttaatctttggagccaaagatgcttctgtttcttctctgtgcctgcacatgtgcctcttctctgggagattagctcttctgactttttttttttttaaattttaaaacattttaaacatcacagacattctagggtatttctcatcttttaggtctcctggagcttctaggccttggctctgagctcagcatctgggatgatttctcaactttgtactttctgaaatttccctgggatcttttctcagggtgccctctgaccttggagcagtggtcttgaaattgatctaaagatatcttctgttgtgttatatgttcttgaacctttttggtattttaatcttttcttccttttagtttttccttaaatacttaagtcagcccacacatgtttgtatgccaactatgtctgaggcactgttctagttagcagtgataagaatgtttaacatgaccaagctgctgccctcagaaagcttatattcaagtgaggtaaaacaggatagattatcttgctaactagttcacaaactccttgttggcaggaaccacatagggtggtgccttgtatataatctgtgcatagcatatgtgtgttccagcttgtcagataacctcttgaacgtcgtcgtcatatagagaccttcatttaggttttgcacttatttcactgtggtaacacttggtgccttctcccactggctgtcctctcacagcctttgtgatctttgatcttggaatgcttgttttctagcagttgaaagctgaattgaatttttaaaagttcctctagtgcatgctgaagattttattagcttgctgcggcagttccattttagttcctctcatagcatcctctcattgagagctgttatccattttgtgctcttgagaagctccgtgaaattatattgcagtaccaaagtataggtgtgattaactgtgaactggaatcagtgtggccattattttatcagctaaatggatgaagtggttcattcttggcacgtagtagatactcaacaagtatttttacattgactgaaaatgttatgtgttttgattcatggttatataataagcaggacttgatcactactgggtagtttacacagtatggtctgagccatgttgctctactaccatcacttattttccaacttctcaaaatatgtacatgacaaggttgtggtttttttttttttttttttttttgcctgttttgttacatagtcctgtgttaggatattacctaggcaggtttcagctctgagttggctttgcagctctttgctggggcatagtctatcctaatgttagaattaatgtttggtagacacagggtctcactctgttgcccagactgtaggccgtggtgctatctcggcttgaaaccgggaggtggtggctgcagtgaggtgagatcacaccactgtactccagcctgggcaaaagagtgagactcggtctcagaaagaaaaaaaaaaaaaagaattaatgtttatagaagggctcatgaatttcaaaacttgcttcctgtggtacacgggagaaactctagtacaagttgaggggtgccattaaccagaaagatggtaaagagagagggggcaacttacaagtatgtttatattgttctgagagaggttgtggctgttgcacagcttagaatgggaaggaagagactgactttacatgccttcaaaagtaagatcttaactttggcagaaatactataattttccaatatagaacacgtctgttttcaatataaatgtaaaaacacatttaaaaaaaaccagccctgtaggatttaaaacgtatctccattcttggttttctgtagtatttgtcatatattgtttagagttaatcatcctggcttttgatcagaaacccagaaatacacagtaaccccctaattccccaaacacctgtcttgagattttaattcttgctgcaaacagcatttgtttcccaaggcttctctagaatgtgaattgttctttgagatatcccagggaggaagattattaaaaggttactccttttcaaaagttggcattgcaatttagaatggttacaaagtttatcaatgaaaatgaacttgatgcctgagctataattgaaatctttatagcgtctctgctgtttgtccattgtgttacagagcattcattgaaaacttcttccatttctgacatgtccagttcccacccctcaaaaaaaaattatgaaaactacaaaacttcagaacatcatttgaaataattgtgtagggattaggcaccgaagagtttagaacagctgcgttacattaagctataattatggttactttttcttgccacacaggagtttagaaatttgtggttttatttcttaggctattttgtttctgatgattgtcaaatttcatttgagacaatattgccctgcattttaatatttacttagcattttttctctttttgaacagttacataacttagataaactgtgtgtaaatgaaagttacagatagagttttaagtggaatatgtactttattcagatttttattatttgagatgatgatttattgaacataagcaatggagacttttctctcatctgtcattaaatgaatgtctggattagcttataggaagtgctcacagtaataaagctaaatataaagaatgagaatcaagaatatataaagaccagaaatgaatacatcaaaacctgtactatcaataaagttctagtctccgtggtcagtgtcttagacatgaggactgctttaataactgcaagatttcagtgactcagagcaagaagcatctgtttctcacctatgtggaagcttatgttggggtcgtcatgggttaggtgtccacatggctgttcaggtggtcagcctttttccaccttgtgacttagcctcctataggaactgggaacctgcttggttcaggcagtgggtggagaatgaggacagtcctgtgggaggtttttatagaccagcacacattgcttctcatcctactagccgtactcagacatggcctctcttagcttactttaggctggacacatagcagagctatacgccgcaggagaagagaggtcatggggactggtagcataactagtctctaccccagtctgactggaacttgtgtgagcatcctggtggccacagtgaaaggaaatcatcctcagctctatgctgtcattttcaccatgcataaagaagataccagtttcttttccttaatatgtcccccatttcacacttggggctttgaattggttacattgaaaggtgtagtaggtgatgtgctcagtggcattcatgtggtacattgaacagtggttcttgtttggctgtttatcatgtccttaaataaagtgaaagtacaacaatcaaaaacaattctgtggaggatcaaactgacatggtttattatatattttctagttgtgagaataagcacacttcatatccctcaaacagtcattcaggaatataagtgatctcaggtggattttttggtgaaagatgtatagaagatagtttgaagttactgttacagatgcgcttggagtgccagtattttgtcaattaaaggtggctttagagaccgagagagatggttggttagttcaaaatcagtatcctgcatggcaagcttgttctagatcaggggttggtaaactacagcctgtgggccacatctggctctttgcctgattttgcaaggaaaattgtattggaatacagacgtgtttgttcttttatttgtctggggttgctttagtgctgcaaggcagagctgatataggggtaagtggtggcaacagaggctaacttacacagtacgacatatttgctatctggctctttacagtaaaaattcctgacccttgttttggagaacatattttctgccttttctgatggggctcacattgtagtaggtgagaaagctaataaacgacattaaaaaaaaaatatatatatatataatctcccttcacttgctttgctttctttactatgctttctttagtatacagcctatgtgtatgtgtgtgcgtgtatttatacgtgtatatatacgtgtgtgtgtatatatatataaagaaagcgaagcacgtgaagagagagaatatcagagactgccatttttgataaggtggtcagggaagcctatgtgagatgacatttgagcagagatacaaacgaaagtgaaggagtgaaccagctaggcaaatattttgggaatgaaccttatttggggagaaacagcaagtgcccccttgagataccgagtagcagcagggagggcagtgtgaatagggggttgggtagggggatgcgtagtgacagaggtattaaagggccagattgtgtagggccgtatagactgtggtgcactttggattttattctgagtgagatgaaaaaccattgcaaagttttgagcagggacatgataccatttaagttagattgtaagaggatcactaggactgctgtgtagaggatagacaggggacaaaggtagaaggtgggtgtctgtgtgctctgtgtgctaggtaggcattgcgaagtgctgtggctgttggatgaatcagtggttcctgccttgaggaggtcttagtagaatagcagaagaaagagatcactgtaatgcactgctgctgacagagaagcaaaggtgccctgggatggggtaggaggggtacctgatccaaaccaaaggtgacaccttgacctgagaatttagagggggctgatgaagactctgattgtatatcagagctctgagattcttggaaggactacttgcatgcaggaattttccccacctgttaaccacgtgagcaagtgctcatccagagatgagtggtttggtggcttttaggtcacatgccagtgccaacaattgcagtctggagcattgtgttagagtgatgttaaggtggtatctcagctcagcaggatacaccacaggaactgaagggtgaaatatttgccatctttgccagagagcagaaccaaagtaattttggtttgggaaagttagtaccataggactgtagaaaagtctcagtaaattgtctgtggaatgtattgtagagtattgctactttccccgtatgcctggcagtatgaattagttgcacaatgtacgtctcagtaattaagcaaaccggtctgctgtctggagttattggatatgacccaattaaactttggaggatgtctgtaaaaatgattttatttttgggacaggtgatagtaaagtattttggataattagttgaaaaaattgctgccgttttaaattagtgtagaagaggacattcacctttctgttttctataatggggtgtctagatcatctagagagaattttaattatcataatattggtttaaaaagaagtagggagagaaaataaaatcacaatcatagaggaaagtttttttttgtactttctctgcaactgatagaacaaaggatatagatgatttgaacaaaacaattaataaaattgcctcagtgtgtctagctgttgtacctaatggcagaatgcacattctttgtaagtagactggacagtatctatcagcttgttgggaaaagcaagtttgagtatattttagaagattgaattcgaacagagtgttctataaattaaactaaaatcaatagcaaaaggtagctagaaaaccttttctaagtatcccatgatcaaagaagatattacggtgagaattagaaaattttacaaaatatgttgattagaatcaatatgaaaatactgtatataaaaatttgtgaggtgcagctaaagtcatactcagaggaaagattatagccttacatgcatgtgttaggaaagaagaaagcctgaaaaatactcaatgatgtgaacatcaattttaagaagttagaaaggaacagcatactaaacccagaggaagtagatagacattaaacgaggagaaattgatagaatagaaaataaatatacagtagagaacatctgcagtactagttttattgaaaagattgatgatatcaatcaatttggtgagattaataaattaaaataaaagacggaaggcacagataacaatgtcagccatgaaaaagagaacatcctaaaatatcctacaggcggtaaagatttttaacaagatattcatttatgctaatacatttttaactttagattaaatggacaagtttttccttaaatgtggttttgttattcatttaaattataccttgatcagccgggcgcggtggctcatgcctttaatcccagcactttgggaggccaaggtgggcggatcacttgaggtcaggagtttgagaccagcctggccaatgtggtgaaaccccatctctactaaaattacaaaaaaattagccgggtgtcgtggcaggcgcctgtaattccagctacgtgggaggctgaggcaggagaatcgcttgaacctgggaggtggaggttgcagtgagctgagatcctgccactgcactgcagcctgggggacaagagcaaaactgcgtctcaaaaaaacaaaaaattacaccttgatcatttgttttagggtccttgttgatttgattttctttttaacataatctaatacaaaactacaaaaaccgtagtttcagagaagtgtcactccctctcatatccctttgactgtgtcctttctccctcttgtaaataaccagcctcacttttctagtttcttttaagacagtatacatgtatgttttcttatttacctttttttcaaaaacagaaggtggcatactgtttaaattctgttgcactttgctttttttcacttaaaatatactctagaaattaattactctttatcagattccagagctcttcctcataatgttatagctgtatagtgctgttcacatagtgtgaatatgatgcagtttcgttaccagtcttctgtgtttggacatttaggtagcttccaatattttgcaattacagtacaaataatgtggctatgaataaccttgtgtatgtatttttatattgcaggaggtttaatttgggaataaagtcctcaaatttggatttctgggttgaaggataaatgtatatgtaatcttgttagacgctgctgaattccccttcatagagattgtaccattttgcattactctgagcagtgtgtgagtgcccgtttctttatagcctgctagttagaggatattgtgaagctttcaaatttttgccaatctaataggtgaaaaatctttgtgtagtttaattatatttattttctttattatgactaaagttgaggatcttttatgttcaagggaaatttttatattattttgagaattgtctattgcccttttttctatagaatttttgcaccttttctgttcattttttaaaagtttttctttgccttaggaataatattcctttgatatatgttacaatatttctcctagttttgacttttctgatttttttccccatgaaaatatcttcatgtagtcagatttatcaagcttttctttaattgaattgggcatgggttttgagtcaaggtcagattatttatagagggattcaccaatattttattctagtacttgagtagttttcattttttacatttagatttatgatacgctacaaatttattctgatatatatggtgtgaggaatagatctgattttgtcttcttctgaatagtgattgagttgtaccaacaccatttataaagttcatctttacccagttattagtgatgccaccattgctgtatattagatttctgtatgtagctgggtctatttttgggcgttccattccattctgttgttctgtctgttcatatgctattcacacaattttaatcatgaggctttgttttaatatttggaaagggcatttctccctcttagctcctcccttgcacatttactgagctggtcttttgtgtttgcttttccacatgaacttcagcatcaatttgttgagctccattaaaaagctgtgtaatttttattggaattgctttatatttacaaatcaactctgacaacctgatgaagttgtgatgtcttagccaagaacagtcgaatgttcgtctgctttcatgtgcctttcagatgtgtataaatttatagatttctttgtataggttttgaacatttcttattgtttattcctgagtattttgttgctgttataaatgggactttctgttccattttacattctaactggttattctttgtgtatgtgaagactagtttgtttactttatatcttgctaccttgcttaattctttaattgtttgagttaattttgtcattgattcctggagtttttcaggtttactaacatgtcatcaaccactagagagttgttgttctttttttccattgtttgtgcctttaattgttttctgttgtctaattgccttggtgaataccttcagaaaaatgttaaatagtggaaaaggtagtgggcattcgtatctggttcctgaccttaatgagaatgtgtgtagaatttgccctttaggatgttggcacttgcactcaccgtgtgtatgtgcgtgcatgcacatgctcttacactaattcattcttgttctgtcttaagttatgttaagaaagtatgcgtctactcctatttattctatatatatattaggaatgaatactgaattttgttgagggcttttttggcctcctgtggaggcaattatatgactttcttgttagacttatgaatatggtgaattatattactagatttcctaatcggaatcattattgcattcctggtataaactccttttttgaggtggagttttgctctgtcgcccaggctggagtacagtggcacgatctcggctcactgcaacctcggcctcccagattcaagcgattctgccgagtagctgagactataggcacgtaccaccatgctgggctaatttttgtatttttagtagagatggggtttcaccatgttggccaggctgatcatgaactcctgacttcaagtgatccgcctgcctcagcctcccaaagtgctgggattacaggcgggagccaccgcgcctggcctggtataaactcttaatgtggtgttggagtctgttaatattttatttcagaatttggcattaatattcatatgtgatattggtttgtaatgttcctattttgtgtgatcacagtcaggttcagttattaatattacacttgatttataaaaaaggatttggcaatattttttcatgtttaaaaaaattgatgtaatattgggattatctggtttgtataggtttgatagacttgcctcttgatatcatctgggttttttgggggagggtagtttgataacttttttcagttcttctatggaatttagttggcctaagctttctatctctatgggtgtccatttgggtaaactctgttttcctatgaaattatccatttcatctaggcttttaaattcatttccatagaggtgtacagagtactttcctgtgattaatatattttatcttttttgtatttgtgcatttgctcatttttccttgataaacttagattgtgctttatttcagttttttttgaggtaaaatatacataacattaagtttatggttttaaccatttttaagtgcacagttcattttatcctttgctgtgcagaagctttttaatttgatgcaatcccatttgtttatttttgcttttgtttccttgattactactttaaatgtgttctatggactctgatgtataggttctcattatctctcagaaattcagtcatttgtttgtatatcccttttcacccaagagttgtataaatttttaggtggaaaggcttttttgttcttaatttctagttttattttccttgatttaattactagtattattatttttgtatattttactgatatgaatacagaaaagtctacatcagaagtatagttgaattttcacaaaatgaattcatccatgaaaccagtactcagaccattcccagaacttcagaaggccctcacattcccttcatctcatgcccacccctctccaaaggtaaccactaagttgacttctaatattgagttttgtctgcttttgaactttacagaaataaatcattattatgtagttttgtttttaaatctttcattcaacaagttttgttaaattcatctgttatttttgctgtataattttccattgtataactgtaccactgttcatttgtccacctctccttacagtatttgtatcattttcagtgttttgtatttctagttttgtttttgcactgtgatcagaggatattttttgtgatatttccattttatgaacatagtaatgatttctttgtgccttaacatataattttctgtgagtgttcaagaagctatattctctgttaccagagtggagtgctgtctctctctctatatatacagaacaactactttgttggttatattgttgaaatcatttatatcttttttttcctatgctctgctttgtatcaagtagtgtgttttatttatggtgtgtttctatttatttactcttggatcaggcataatttgttatttagttcatagagattaataatgtattctgcattgtgaaattaacttttagtatttaaaagtagttaggactattcagataacttttgtcttgattttttttttgtctgattatttttattcacctggtaaatttttgttcctttatttttagcctttttgaatcactgcattttaagtatgtcttttatatacagcatagtctttgctttctaagcaaatttgaaaatatctttcttttaataagcaagttaagctgattcatattaattgttataactgataggtttgttctcagttctgtcattgtgttaaattactgtctgtattttggtatatttactctgttcatttattgtttgatgtgtttttcttaatttaaaaaattcttttgatatcaggaaggtgggactaagtttttcttctaatagtaccattgaattcgtacttttgtagtaccttaaccccttcttttttttttttttgagatggagtctcgctgtgtcacccaggctggagtgcagtggtgcgatctcggctcactgcaagctgcacctcctgggttcacaccattgtcctgcctcagcctctggagtagctgggactacaggcacctgccaccacgcccggctaattttttgtatttttactagagacggggttacactgtgttagccaggatggtctcgatctcctgaccttgtgatccgcccaccttggcctcccacagcgctgggattacaggcgtgagccaccgtgcttggccaaccccttcttatttttaacctatctttttactgtcttgtatgctacttttataaggcatcttttccttctcatctgttcacgatacaatcacctatgattgtatggcttttttttctttcctttttctcttccctttcctcccattatttcagttgcattttcaaatcttttcaggacatatacagtttatgtatcatttttctgtcttgtttttattcttagttctacagttaaatacataaaatgcttactttgtgaccagtccttttgcttacgtttctttagtcatcccttgtttagatggagctcaagcccggatgttccattgaatgtaatgtgtcagtgtctctcctgtgcatctaggattctattagttgtataatgttcttggcagaactgagaacatagttagcctgtggtccagatgatgaacctgggttgagaaagggattagaaccctcaggaaagatacatgtgtaagtattttatgagttcttgcttgttcaaagtttttttattagcctcgttagttgaaggacaggtaggcttgatatacaatcctttttactgagcttcttttcttatttttagtatttatttatttgagacaggttctagaatgattttctactagtcttgctttttatgttgctttgctaagtctgatgccaggctgattcattctctgatatcattctgtgatatcttttagcatggaggcctcgaagatatctttcatatgcgtaaagtctaatagtttactaggttacatttttggggtagtttgttcttggtcagttttccccagttggctcttaaaatgtgtagattcaggtcttttattttcaggaagtttttttagagtattattttaaatattctgttttagtgttttgaatatcttcttccagagtttgatgtatatgtatcttggaggtatatgtatttctaattatataaatatttgaccctctttgcctaatttgttttattcacttcaactttgaccctttatacttctttttaaatttcactttcttatggttgtttttctacttttcctcaatgccctttgtaaaattttcatttgaatctattattctcccttggacatcttaattccttctctactatgactttttctttcttttgtttctttcctgggttcaagccactcctgtttcattactttctttttttttccttttctatttttactcttctttggggtcttgaactgtaagaggtcctggaacataaatttgagaattgttgcatcatacagtagtggtttacgtggggaatttcagaagtactgaggcctttgacctagcctcagaaattgcagtggtctgaagtggtacgtgggctttgaatattttaaatgatagccaggagattgtaatgtttaggaacttcactgagatatagtttggagtgtggtacatcatgtgcttatgtaacttatgtacttactatctcaaaaaaggtctaagtcagtggttcccaagttttcagagaagagtcatctgaagatcatattcatttttcatagtttgttgttagtatgtagaattacagttaactttaaaaataactttattgtggaacaataatagactcattggaaatgcaaaaatagttcacagaggttctatgtattctttacccagcttcctccagtggtaacatcctacgtaactatagtataatatcaaaaccgcccttttggctctctgagcagcaccatggctgttggcaagaacaaacgccttacgaaaggaggcaaaaagggagccaagaagaaagtggttgatccattttctaagaaagagtggtatgatgtgaaagcaccttctgtgttcaatataaggaatattggaaagatgctagtcaccaggacccaaggaaacaaaattgcatctgatggcctcaagggtcatgtgtttgaagtgagtcttgctgatttgcagaaagatgagattgcatttagaaaattcaagctgattactgaagatgttcagggcaaaaacttcctaacttccttggcatggatcttacctgtgacaaaatgtgttccatggtcaaaaaatggcagacagtgattaaagctcatgttgatgtcaggactaccgatggttacttgctttgtctgttctgtgttggttttcctaaaaacaatgtaacaatccgatatggaaaaccttttatgctcagcaccaacaggtccgccaaatccggaagaatatgatggaaatcaagacccgggaggtgcagaaaaatgacttgaaagaagtggtcaataaattgattccagacagcattggaaaagacatagaaaagacttgccaatccatttatcctctccatgatgtcttcgttagaaaagtaaaaatgctgaagaagcccaagtttgaattgggaaaactcatggagcttcatggtgaaggcagtagttctggaaaagccactgggagcaagacaggtgctaaagttgaatgagctgatggatatgaaccaccagtccaagaatctgtttaaagttcagacttataataatggcaagtaaaaagtcctatttgtggaaaaaaaaaaatcaaaaccaggaaattgacattggtacaatctgcagaccttattcagatttcactagtttatacatgcactcagttgtgtgttctgtgcaatttaatcatgtgtataggttcatgtaatcactaccacatcaagttacagaactgttccatcagcacagaggaactcccttaggtttcctctttgtagtcactacagttgatttctttatattaatttgtatcatgtgactttgttgaatttgtcttttaattctagtagttttattgtggattccttagacttttttttatgtataggatcataaaatgtggtaatcatgaaattgactagcaagacaattttacctcttttccaatctagatactttctcctcctttccccccttcttttctttcctcctgccttattgcactggatagaacttcctttagaatattgcgtagaaattataagattagatattcctcccttgttcctgatttcagggggaaagcattcagtccttcaacattaagtgtgattttagttgttttcttgtagacgacttaccaggttgaaaaatttttcttctaagtctaggagtttttaatcactgtgataagtttaataaagttgctaccttagcattcattttaggcctaacataaattgttcgtaattcagtcatgccctgtcacctttggcctagttagaacttcccctccctgcagttgtttgcaatatggcctacttgtgcctcatctcactgacccaaaatgcaacacaccatgagctgccgatcacagtaaaacctaatggtcagcctcagaagtcatgtgaataagttcccattcacatttgttttctttaaccaattcacaagaaggaaagcataaggaataatgtcccttaaaggtgtagttccacagttcttctttctccctctccctcctgctccttccctctcctgtctcaggacctcctgtctgtctctgtttggcactctaacctctctgggacctatgagtaataaacttctttcgtttcatgtattttgccttagcttcctcattgtgtctccattgagacacacatactgtattgttcttgatatcatttaacatcttttctttaacaaatcaacagtcatgaatggatattggattttgggaaatgctttttctattgagatgatcatgtgattttgtcctttatgatagtagttattatattgatttttggagattaagctaaccttatattcttgggatacatttcctttttttttttttttttttttttgtgggtcagggtcttgctctgttgcacaggctggagagcagtggtgcaatcatagctcactgtaaccccaaactccgggctcaggtgagcctcccacctcagcctcctgagtagcttggactactggtgtgtgccactaggaccagcgaattttttaagtttttttttaaagatggggtctcactatgctgctgaggctggtcttgaacccctggcttcaagtggtcctcttgccttaaggagagagaaactagattaaaatacaaaagtaaatacccaagcctagagaaggggaaagatagtgatgactattattaacaaattaattatagtaattattattttttgcttaccattagttaattttggatagcagacacatacattcaaatattttaatagtccatgaaatatataggtgggtagtctggttctagacacatgttaagctgaagtgccaaggataggaagtaaggttgaaagtagtggcattcttttactgaaaagacatttactttttgggttgttttgcaggtataatggtatctcatctacattgtcactttgcctagtttactattttgttttttgtttgtttcagtgaattcctgaaagagaaaaaataaacaacatgattctctctgtaacagccccctggaccccctcacccagtgttcagcatgatatagacccttgtgtttaccctttttttaaaaccaggaaatggcgctcctggtgtttggtgtgagcactgattatgcttggtcatcagaaatgaatgaactggcaagggaaatgaataaatgagctcagagaaagcaaaactgaatcatgctgaagatgctttctaggatgattgtatttctgaaaccttaaatcaagcttgtccaacctatggcccatgggctgcatgtggcccagaatggctttgaatgcagcccaacacaaatttgtaaattttcttagaacattacaagatttttttgtgatttatttattatttacttatttttagctcattagctgtctttagtgttagtgttagtgtattttatgtgtggcccaagacaattcttcttccagtgtggcccagggaagccaaaagattggacacccctgccttagatattgaaaattagaggtgcctgcatttccagtaattaagacaattcttactgtgcatttttttgctttccattatctttcattaaaaaaatctccaacttttaccttttagaatattaggatagaatcttattaatatgaatacgtccaaaagttggcttttgtggttttcttttgtcagaagtgctgtaggataatataacttaaaacacatacagttttctgcttctctcaagatgttcagttgtttttcagaaacacctgaatgaatggtgctaaactttccatgggctttgtctaaaactcgacaagcattagattaatatttcttttgtaggtccaattagcattcaaatattattcctgaagtattggatttcatatgttattttttgttgcttgttgatattttggttttattttgggggctgcctaattctcaggtcaaattatttctggtagttttgaaatttcttttttctttctttttttttttttttgagacagagtttttgctcttgttgctcagactggagtgcgatggcacgatctcggctcacctcaacctccgcctcccgggttcaagcgattcttctgcctcagcctcccgagtagctgggattacaggcgtgtgccaccacacccggctaattttatatttttagtagagatggagtttctccatgttggtcaggttggtctcgagctcccgacctcaggtgatctgcccagctcggcctcccaaagtgttgggattacaggcgtgagccactgcacccagcataaatttcttttttttttttttttaaggcaaggtcacactcctgtcacccaagctggggtgcagtggtacaatcttggctcactgcaagcttgacttctgggatcagttgatccccccacctcagcctcctgagtagctgggattacaggcatgtaccaccatgcctggctaattttttgtatttttagaagagatggggttttgccatgttgcccaggctggtcttgaactcttgagctcaagtgatctgcctgtcttggcctcccaaaatgctgggattataggtgtgagccactatacctggtcaaatttcttttttttaagattattttgaaagtatcggttgtgataaaatgaggaaaccatatgtgaatggatggaatgtggtgtcttttcctaagttgaatagaatttgattaatctgactatcctcagaagattttgcaaatttcatttaaatttaagttaacagaatttctgaagtagtaatctgaggagttaacctaggccagccaattttttttttttttaacagttgaatgaatagaaatccagaaaagtttgagttgagcaaggcattttgatctatttccccacagaaatcagtgggaaaactttcacttttgttccaatcagagcaactcccttttagttgtttagtgttttgattaaagttttattttaagaaaggttctgctttaaaaaaaaaagttacaaaaccactgcttttaaggggaagggatcccaaataagtatgagtggaaagctatcagagtctcttggcttttttaaaaaattagcgcctactagagagtctttccttgacagttatttgctataaactaggctttgatatgatcagaatagaaggcatcatttggagtatcaaatacagaggaaaataaagtgattcttcagcctttgctttggcatagaatgttaccaggtatggacttaactatgtttgctgaaattattttcaggttttagagtcaggaatgaaggaacattccttgagtatttgatagatttgtggtttatagacagtaaattctataatcgatgagcttcctctttagaagttcttgaaccaaatttatggttcactgtaagccagtgtataggatttaaaaggatgagtctttgcatgagtctgatttctaactcatttgatacttctttttcacttccaataaatgttatcttgctttctgaacaaagtaggttatacataaatgcaattacatacggatggttcctgactatacctacacccttgtgtaggtttcaggctctggactggatgctctgttgcctctaagacctgatgggacaggtcaggagcaggggctttggggccagactgatttgtgttcaaatcttgactctgttgtttattagctgtgtgattcggggacatttcttaacttctgtgatccttgatttcctaatctaaaaaagaaagccgggccgggcacggtggctcacacctgtaatcctagcactttgggaggccgaggtgggcggattgcctgagctcaggagttcgagaacagcctgggcaacacagtgaaaaccctgtctctactaaaatacaaaaaattagctaggtgtggtggtgtgcacctgtagtcccagttactcgggaggctgaggcaggagaattgcttgaacccgggaggtggaggttgcagtgagccgagatcataccactacactctagcctgggtgaccgagtgagactccgtctcaaaaaaaaaaaaaaaaaaaaaaagcctacctcacagtgttgtacttaaagagtatacttaagtaagagaatgtaaataataaagtgcttagtactgtaccgagaatagaaaatttcccagtaactggcagagtaaagaaagcagcaatagagagaaaatccctaagaaaccttcagatctgtatgtgtgttctgagaccataccttggaagagagggcaaaaacaatgtaggtctctttttccagctattaacatatattctaataggatagataccttgagagaataattagtcaataagaaagataatgacaggcacctctatggatgcttaaaatgggggcagaaagaaattaatgctaaagtggtaatttgaagcctagggtcttagtggaaagatagcaatagccatggtaaagcagtttggacagttactgtggatagcatctatcacttttgataagagtacatgtttgcataatgatttatgggttaagtgtctttagttatgtgatctcatttgatgtatacaacaccataaggtggcttattattcagatgacactggtcacatggggacaagttccaaagggagcaagcaaggacagaaaaaacaattattttccgtaatggttaagaaacggaaaggttcttatagtcacaaatggcaagtgaacagtaaagctggttcaagaaatcctgattctagtctagggctccttctcctatagtgtttattattttgtttttactcaaaatggaaatacttaaagatgcagagtagttcataattagagtaggcagaagtgggggtgaagctaagagtcgaaggctccttaagcccaagtaggagttattttctgctaggtagtgtctttcattgaaaattccttatttcattgaaaatttttttaaattatgaatttgattatattacttgttatttctttgaaccatttttcagaagaatgaccctgagcacactctgctatggtgtttgtactttaccctctgtatttcatttctagaacatccttttcccacttcttttagcttcgaccatcttttgaagccactctagctttgttggagtttgctttgtgatcaggaggctacctaaagcctgtttcagtctcttcaaatagctacagcagcggcagatagtaacaggagtcagaagtgtggttgccactcaagtagcccaaaaaggtttgcagtgcagaagctgaaatggcttaccacagatgtgatccacttaaaaaggttctgaaaactcaattcagtgaagtgtgtttgggctcagtgcattggacctgtgacttcctgtaatgtttacttaaccccctaacttctaagtggtacctcccccacctccctggaggggaaaaagatacgcaattggttttgcaggattatggagatcaaacaagcatctaacaaagactcttccttccaggtacctctttctctcttccctctcatcatagattaatcacttagttgcaagggaccagtaaattaacagaatggtgaacattttccttttcttggtgcttttgctggatgactagtggtttctgctggaacagagatgaaccatctcaaggttatgaaaattcctgactgtggcaaatgtgaaagagtgtctttttaattcctgggaaatactaagacttcttctctaaggtgcttatttgtaaagtaaaaaggtgaccttaatttccagtgctatgcagtgaacacaatttttgtggaaactagttctaggatttgaaatgaagactatatggtctctgttaatctgtattggtaaacgcactgcactttattgagagttctggtcgttaaccagcggaattactagtattatagaaatttattaaggatggcttattggagttgacttgtaatttcagtcatttctttgtaattacgaggtaaaagatgatttgtcttgagtttaattatttctgtaagttaaaataaggaatttgtaaagcattcctcagttttatgttcagttatctaggaaacatgcagcaaagaaaggatgtgagataattattcagaaattttagttgctcgtggttgtgtgttgaaggcatatacgtgacaagcagttttggaatttcttgcaaagtcagtattgccctatagattgaccttacagaaagtccttattgtgtgtttcaaagtcttctttgtaaattaaaatatgaaagctgttgttactctgctgatagttctgataactcatgctaactaaatagttaagggagtggaagaatacagccagcattccatcatctggaaggaaaatagtgaggtggcagatccctgcctgactcagctttcaccatgccataaataatatcattttcccaagcaatactgtggaatgcaaaaagaaagaaaaatgtaaaaaaaaaaaaagtggactgagatgaagaaagccaatttatagttgtaataaataatattttgtgtcaaaaaggaagaacaaattgacaagaacttggagaaataccagctatggataaagggaaataaaaatgatggaaatccagatggtatagaactaaagatccaaatgtaaacagcagctgtttacattaattatcttgtggatggagtccctcactgagctgatatgctgttacgttagtgctttcaggttttgggttgaatcacttaggtatgcctacacacttgctttgagaaaaatcatatggttagctgtgctttccttaataatgataagttaaataactataattttactatactcagtcatatggagagatttgaagactgaagtataattctgtgttactgctagttggtaagcagatgtccctacctcatggtctctttgactaagttagattgtaagcctctggaaggcagaagactgttcttcatctcaggtttggcataatgcctttcatatagtaggggctcaggaatctctgttgatgttataaatttgataagtgttcactgctgaacctgcatgttgatggtaagaccatataatggtcttacctagaaaaaccatataatggtcttacctagaaaaaccttttgacttgtattgctttgctctatcttctgctgaaattaaactataaaccccccaaatgcataataaaagcccttgccttgctgtgtggctgacagtttctaatgtgagtggaggtaatagctgaggatggtgctgtagaaaacttacctcataggcctaggaaagaaaggtttaaggctatcatcatggattctgttagatgacttgatttttactgtattaaaagcttcctttccagtgatttgggattgcatggaatagagtgctgtacttgggtgtcacagaaccctgggtttgtggatagaattatgatgccccaaaaatacctcatttgatatataatcttgattttgtttatagaattttctgtaatgaagtaatatttgatttttttcaagtagtttaatatttgccctttattgtttttcaataatattttgaaagacgttttcttcttcaagattgttaaaaatattttttgtgtttcttttcgctctttattggttttattttgcacatttttgctgttaatacatctgaaacttcttttggtataaggggtaaagtgaggactcaatttgatttttttctcctaatgagtatccagttgttataatagcatttaaccaataactcttaccctagggatttaaaatgtcacatccatcttatactgagttcctatatatactgccagtttctgcattttctagtctattccattataggtttatttattcacactattttaattattgaagctatataatgttttaatatctgataggggatgttctctacccttattcttctttttcagaattgtcttgtctgtctttgtttgcttttctataagaactttcaagtaagcttgtctagttcctaagagaattgtcagggatactcaagaaacacctgccctttgtgatcaattctaagagccccatctgtattataaatctggagactgggttttagaccttattctgacattaactggctctgtaataaaaagattaaattcatgttttactattttatagatgtttgcaggtgcttttaagagagttattttgtactgacaatttttttggtttctatattctcatcactaaatagagctattttaaaaatcctcaatttcagtctggtcaacatggcgaaaccctgtctttaccaaaaatacaaaaaattagccaggtgtggtggcacacacctgtagtcctggctacttgggaggttgaggtgggcggatcacttgagcctgggaggtggaggttgcagtgagccaggattgtgccactacactgtagcctgggcgacagattaagaccctgcctcaaaaaaaaaaaaaaaaaaaaaaggaagaagaatcctcagttttctttttaaaaagaatcctcattttttttgctttttttttttggtggtttgtttgttttttagtattgcagaggggtcctcatacttggaaaaattggaaacaactgaattagagttccctaaactctgttttttttttttgaaaattcaattctaaataaataaaaggtggtgtatcatcaatccaatcaaggattgaatttaaatctttgtggcctctgaaagggctacacagtggagggaaactacagaaatggctcttggcaagatcatttgtctgtttcttttcctctataaccagttggtgttttgaaaggaagcatattgtctagattttcagagttctctaaaaacaggatggaggagtattatttttgaagtatgtagcatgattgtatcttcagcacaattaagtgctttgaaagcttaaattatttgtgctgtcataattgactattatgattgaaataaggatgtatatcttctttgctttttgagtgttgctagattgagagctgctggacagaatgatgggttcatgggagaagacaatcaagggggtggtaattctctaaagtcaaacttgacattttgaagggcacatcagtctgtagcttgtataattctgtaacaaattggaaaataatggaacaaatgaagaggaaaaattggtcttcatctgttggtgaatgtcagtcactattaaattaaaatgagtttttaaaatgaagagaccaaaagttttttttgtctcttttggaaagttacattgagaattcattgatttatgattgctataggacttaaaaagaaaaaagactaaaaaatccaaaaccaaatcctaaagaaaagtttaccagcaactccataatcccatcaagaataatattctgaagtagagggcaaggtttggaattggttgactctagttacacaagactcagtctattaaataactgtaaataatgttcttaagcagaagtaaatgtgataaatcagataagctgatagaaattactattcttcaaatcagaaagatgagaaggaaggttaggaaaaacaagaatataagcaaaaaataaccctagagtgtaagtctgaaaaattcagagtgggagttggtttattgaatcctcaaatgctgtttgtttgtatgctaaatggaaatagaggcagcataacttaatgtgatgtgaggtttatgttttcactgtttaaaaacacaacatgaccagaccaaatcagaaccacagagtcccaattccagatttctgggagggaaacctggcccattttaggtagtgtctgtccccattcagtcagctgtggccaggaggttggggtaagagattaaaccttacttgtgtttttaccaaagtcaaatagtatccccaaatcggcttctgtttcagttatcatcacagattacattttaggaaatgtgtatatatttttcttctggattctaatttgatcttgtcgaacgttttgtagttttaaaatgcgtaacagtttacttcctccagtaaagtgtcagagagtacctgtgtccctccccatcctggccaacaccgggatttttcatatgtttaatctttgctcatctaacaagttaaaatggtatggcattgcagctctaatttgtatttcttctataatttatttatttttttaagacagtctcactctgtcacccaggctggagcgcagtggcatgattatggctcactgcagccttgacctcctgggctcaagtgattctcccacctcagcctcccaagtggctggggccacaggcacacaccaccacacccagctattttttttttggtagagatggcgtttcaccatgttgccgaggctagtctcaaactcttgggctcaaatgaccctcttgcctcagtctctcaaagtgctgggattataggcacgagctactgtgcctggccctgtatttctttatattgcttgaggttgagcattcttccatgtctgcttttcaaatactcagtagatggatagttacttcgttcctttctgtttttgttcaaccaaataggtagactgtggggcattttgtgagagtattagtttggaagaagtttcaacttgttctatcagacatgaagtttagcactaaaaatggttcctctcagaactgggtaatgtggagtggagggggcagtgcctggagagcattgaaggaagaagtggccactgaacagggtgtcatgttgggaattgctgtgattgcaagatatcagaactttactgcaaattgagcccagcagggatgggcaaccatatggcttagaaagtgacttatgtaggcaagtggtaaagtcttactgaggtttagtgatgcaagcctgatgtggcatcgtcaatagatgcatttgtttgaggagtcttgctgttttggctttagttgaatgttaagaataaaattggtaccatgttaatacttttagaatgatttttgactatatctagtatttaaagcttttctttagttatttctccaaagcacaacagagtttggcagatttatgtgtgaacttaaaataaaataaaagataatgctgttagtgtagtttggggtgtaggataccttctgcctctgagggaatgttagacctcatgctttggattgttttgaacagaggtaaacatactcaatttgactagatgtatctgtagattttaatgttagtgagcagtgctgtcctgcttcttgtgttagtttcttgaatggccaccccccattgctggacttacgccagggcagaagaaggttcacctcatgagctcagtgtacaggaaggaatggaaaacatgaacatgcttttgcttttctatgtgtaacttccccttcccctttgaaaccaattcttttggaaagctgcaactgaagacccatatctgaatagcattctaacagtatttctcattaatatgctttgtcagtcctcagtttgtaagacattgtcagaatgttcttggtttgaagcctggatgctttcatttcccatcgcgctaatttccatcctgttaattttttattcgtgaccctctgctgagaggcccccccaacacctgttaaatcacagagaaaaaagtaaaatttgtggtatttttagttatttctgtactaataagattgccacctcttaactctttgtaaaaatgtaacatggtatttactttaactccagtaatagttttgaattttgacctttttttatttgagaaaaaagaaacccgaaagaaggtggaaaatagattatttggttaaaatttctttttctctttaaatgtctttactcctacagatgtcacctttaaatgtgagtcttaaaccagaaatatgccctataaatctactcacaaaagtaatctggatgggatttaagcccaggcagatctcaatgagattgttaggtgagatcaccaagggagggcacacagagaaagggtccaaatcaatatgtcaaaagtctgctaagctaatatttctctgcgttcttctatgtaaaatgtgggaataaaatgccacatacactttttatcctttcagcagtgagttattgcacacctactgtgttccatgcactgatctgggcactgggacacatcagtgaacaaaacctcaaaaaaatccctgccctcacaaagctgacattttaatgggagaattgggcagtaaaggagacaaattaataaattattcacatgtagcatattagaagataatagatggtaatggagagaactaaatcatttaaaaagggtaaggaggttcaggacttgcagttttaattggggtgaggcagaagtaatatttgggcagagatttgaaggaggtgtgagggactgagccacgcaggtgtaggtgggtggggcggaacattccaggagagatggtagcaagtgcaaaggtcttggtgggctgctctctagtgtgtgtgttcagggaggagacctgcagtagaatgaggaggggagagggagagagtaagagatgaggacagagtggttaggggagggaaggaagcaggtcatgtggctctcttaggtcatcgtaaaggttttagattttcatcacactgtgtgtgctgaacggccaccagagggtttgaaatggaagagagatgtgatccaacttctttgacagaaatgctctagcttctcaggaaaacagtctgttggggaacagagaataaagtggagaccagccgggaggcttgggtgaggatgcaagcagttgaggtgggggaagcagtaggattttgatgtatttagaaggtggaaacactagtaggatttactggtggatctgacagtgagggagggaaattaaggatgcccagggtttttgacttgagcagctgagatatggggttgccatgaactgagagggggagactacgagctctagattgctggggaacgtcaggagttcaattttgggcatgttatatttcatattagggttgtgtattagacatccacgtgaagacactgagttagctgttgagtatacagtttcaaagttcatggaagtggtctgggctggagatgggaatttgggagttgtcaggatatatgtggcatttaaaaccatgagatcaggaaaggagggagtcgggatagagaagagaaaaggtccgaggactgagttgtaggttcttgaggtcggggatgctttaggaacggctgggcactggtgactattacttggtcaccccttaaggtacttgcatccctgccgggctcactgtggggtgttaatcccagtgcactcagctgttatttcagaatggatgtctaactggaaagatactaggtagtcattcaaaaggacctcaaaggagcaggcgagtttttttttttttttttttgctttctaccgcagtgattctagattattttgggctttgcttgatttctggaccaataagctttgctgaactgcagttttaatgaagttcatgatatcaccaatctctacaaagtgatttatttaactaatctctaataataaaatatttcaacctgacagctgactttttaagaagcatgtgattaatagtagtttgagtgataattaattttcaggaaagattccagaatattggaaatatttttgtttttttgcgggagtgaatctgttttatttatgaattttatggtaattttaccttacagtgtgtcttagctcaggctgcgtaacaaaataccacagactgtatagcttaaacaacagagatttattttctcatagttctggaggctatgaagtccacgaacacagttccagcagggttcagttcctggtgagggccatctttctggtttacctgcgagttctttgtcctcagatggcctttcttctgagtgggtgcagagagtgtgagtttggtgtctcttcttctaaggccataggtcccataggatccagctcccaccctatgacctcatttaaccttaattaccactataaaggccctacctccaaatgcatcacattagggttgggagcttccacatgattttggtggattatatacaattcagtgtataatacaatgtcttctcaatttctctccctctaatatgaagacattcttatcagtgtcttgtcagttgtctgttccagggtaattttttcaggataaatgtcattgagctgtgtatgcgtgtgcctgtctctgtgggttaagcatacatggattattttctaaggtcatttctgtaatgatacacaacttgtggcaatatttacagtgattttcttcacaaatgtttttgcacaaatgtttaagcagtctaatatttttatttcaggaattggtttttgggtttctgtagcatttgagtactgtttctaggggatgttaacggtttttagggagtccctgccgtgcaatattggttcagtgaatggatgaataaacttaggtgaatgtatgtgggtggggagtgggggcgttgtactgtaatgaaagtggaaatgtaaaaaatatcatcttagcttgtttatggaagggtcatttatcttgcaaaattttctacctttagcattactgaggaattcattttggtccaaaccgacttggccgaagcatgggcttccctcagcgtactgcttgccggtgcctcctgagttttttggtttgagggtgagaaagatgaaaggttatgaaagttctgtcttgtgaatatgctgaagatcaaatcataaagtgtccactctgtttataatttcacctttatttttctaggccatttaccaagccacctgaaatttgctttgttttaaattattgttattattatttactgttagtcttgtgctttatgtctttaaatttaacttcaggtatttttatgtaattgataatattcttttgtcactgttttgtgtgccttagcatttatttcatgtcatattttcttgcagatttatttatttgctctttttgagtcacattccagtggaatccaaggtccataaaaacaaggaattgtctgccttttactgcattttatattcagcacttaggtactagcatatagtaggtatccaataaatattcttgcataaataaatcctatagacactactttgcatgcttttccatttagtgtcatgtcagaaaaatgttatcacataattaacaagtcttctaaaatactgcataggtcattgcataataatttatagctctaacatagtttgctttaaatcagttccttcctttggctgatttagttgcttctgtgttttattacatacataacactgaagggaacatcttcgtgtataaatctttgtccacatttgtgttcattcctttattcatatattactgtattactagaagaagaattagttacattgatttaggtaatttaaggctcttaacatataatgacaacaaaagtattccaatttatactttttaaaatataaattttcaaagggcctttttctcctggaatttcattcttaatactattttcttctcattttgtatttactccccttggccataccatcaaatgctcttctattctagtccttcagttccagcgagggctaatttatggcctctgctccaaggtctaactctgcatttgttagatatctggtggttcccccggtacctcaagatcaccatctccaaaagtgtaattatttttccatcaaaacctgctctttgctgttctgttcccttttgagataaatgaaggtaaaatcttttcagcactcaagctggaattgtgggagtgatcgtcagttcctccgtttcctcttgatcctcagctaacttgtatatgccctttgactcttgcgctcctggctgcagcagtggcctaagcttactaccgtctcctttctggacgattgtattactgccctgttgtagctcctgtatcactttccccgtgtacatcattcatactgccaaagttacctccctggaacgcctgttttctattcctttcctaagtaaattaagttccttccaactctcccggttacttgtagatcctccttatttaacaggggctctgtgtgctctgcctagtccttccctagtctgccttctgtcatttcctggggatttttcttccttctccttcttgggtatcttgaccttttggagctccacattgtctgtcttcctcattcactcctctgtggctgctctctggcagacttctttgtctagaatactgtccctcagttgttcgtttaacattcatcttcagattcagctctgggaagtctttctttacctaccatttcccaacaacaacttccttttctgtataaccaccagcagtgtataagtaccttgataacgtagtcttcaatgtcatttgttgctaatatttatgtgtatgtttgtatcatagacagtatgagtgttatttatctttgatcccatggcacttaccataaagacttgcagaaaagatatttaacaaatgttagttgaacaaaggaatatctcaggaggaacgtactttgacttgatgtctttttggtgttctttcttcctgtttctgtctgatattgtttccattcagtctgaagaacttcagcatctttttaaatatggatctgctcagctttggcttatcagaaaatgtctattttgccttcctttttaaatattaaaccttttatttttatatagtaataatctcacagaacatggcaaaaaagaagttcacagttccatgtacccttgcccagcttccccaaaggtgacatcttttatagcttgtagtacaataccaaaaccaataaattgatactggtacgtactaacgaccttattcactgttcactgtattttaaactgcaggtgtgtgtgtgtgagtgtgtaaagttctctgcagttttagcacatgtgtagattcgtataaccgctgccaccttcaagatacagtactgtcccatcaccacaaaatctcccttgtgcaatttctttgtaccctcagccatcctattccttgtccctggcccctgttcttcatctctattagttgtatcattttcagaatgttacatacatgaaatcataccatatttaacctttgtgattacttttttcactaagcaaaatgtctttgaggtctgtccgggttgttttatgtatcaattgttcattcctttgtattgctgagcagtttacaattgtatggatataccagagttggttcaacaatccacgcaaacaacatttgcattgtttctgctattttgctattatgagtaaagctgctatggacatttgtgtacaggtttttctatgaatatattttctctgggataaatacccatgaatgtgattattggaaagtgaatctttagttttgtaagaatgtgccaaactattttccagagtagctgtactattttacattttcaccagcagtgtgtaagtgatccttttttttttttttttttgcatcctcaccagactttggtattatcactgtttattttaactgttctaacctgaataatgatatctcattgtggttttaatttgcattcttctaatgcctaataatgttgaccatcttttcttctgcttatttgccgtctgtatatcctctttggtgaaatgtttattttttttttgctcttttcataattggattgtttacttttttttttaaaaaaagctagttttgagagttctctctctagtttttttcattagacaaagaatcttgtatgacagtcattttccccacacctcagcattctaaacatgtcagttcatcatattctgactttaattatttttgataaaatttagccttcttaaatgttgcccttattgcagttttctgcaagtcatatgtctcattttcctctggttgctttgagtattttctctttgtctttggtttttagcaatttggctatgatgtgcctaggtgtgatttttctttgtgtttactatctttgggtttaatgagcttcttcgatctgtgggttgatgtccttcattacatttggaaaattatcagattattatttcttaagatatcttttatccggttctctccttgtcttctgggactccagtatattcaagccatttattatttctcagctcttgggcagtttccttgtttgttttccatttttctctctctgcagctcatagaaccaccttctgctatgtccagttttctgttaagctcatcgaatgagttctttctttctgaaattgtaatttccatttctggcttttctatttacctattttgttattttactctgatgaaatcttccaactgctcatgttcacctgctcatctttctcactaagtcttttagtacatttatcatagttatgtctactggttgcaacatcaggatcatatatggatgtaccctctgttgactttttaaaaatggaccatgtttgtctcctccttgtgtcccattatttctatttattattattatttttttgagacatctcactctgtcacccaggctggagtgcagtggtgcaatctcatcccactgcaacctctgcctcctggctttaagccattcttatgcctcagcctcctgagtagttggaattaacaggtgtgtgccaccacacccggctaatgttttgtatttttagtagagatggggcttcgccatgttggccaggctgatctcgaactcctggcttcaagtgatctgcccgcctgggcctccgaaagtgctgggattacaggcgtgagccaccacgcctggccccttgattttttgttgttgttgttgttgttgttgtttttacgttttagtcttttttttttattatactttaagttttagggtacatgtgcacaacgtgcaggtttgttacatatgtatatatgtgccatgttggtgtgctgcacccattaacttgtcatttaacatgttaatgctatccctctgccttcccccagaacaggccccggtgtgtgatgttccccttcctgtgtccatgtgttctcattgttcaattcccacctatgagtgagaacgtgcggtgtttggttttttgtccttgcgatagtttgctgagaatgatagtttccagcttcatccatgtccctacaaaggacatgaactcgtcattttttatggctgcatagtattccatggtgtatatgtgccacattttcttaatccagtctatcattgttggacatttggcctggttccaagtctttgctattgtgaatagtgccgcaataaacatacgtgtgcatgtgtctttatagcagcatgatttataatcctttgggtatatacccagtaatgggattgctgggtcaaatggtatttctagttcaagatccctgaggaatcgccacactgacttccacaatagttgaactagtttacagtcccaccaacagtgtaaaagtgtttctgtttctccacatcctctccagcacctgttgtttcctgtctttctaatgatcgccattctaaccggtatgagatggtatctcattgtggttttgatttgcatttctctgatggccagtgatgatgagcgttttttcatgtgtcttttggctgcataaatgtcttcttttgagaagtgtctgttcatatcctttgcccactttttgatggggttgtttttttcttgtaaatttgtttgagttcattgtagattctggatattagccctttgtcagatgagtagattgcaaaaattttctcccattctgtagtgcctcttcactctgatggtagttccttttgctgtgcagaagctcttcggcccgatgattttttattgtttgctggacattaagaacaagaaagactgaggaatatctatcccggcaaaaggcttgctcttccttttgtcacactgttaatgagggggactgagctggatctgggctttgaagtagcattaattagagtcagtttaccattggattcacatagtttgagagtgggatcacgagtttgttttcggcagttttcactccgaaccccagtaagatcttggagatctctttatgcttcagagccaagctgccagcttcctgagtggtgggagatttctctttgttttatagcttggctgctagcctttctggacagtggtgagttatttatactctttcgatggctttcagctcctcagaaggtatctctttgccctgctctttttaattttatttattattatttattttttgagacggagtctcgctctgttgcccagactggagtgcactggcacgatcttggctcgctgcatcctctgtctccagggttcaaacgattctcctgccttagcctcatgagtagctgggattacacatgcatgccaccgcgcctggctaatttttgtatttttagtagagacagggcttcgccatgttggtctcgaactcctgacctcgggtgattcacccgtcttggtctcccaaagtgctgggattacaggcgtcagccgctgcgcctggcctgccctgctcttcttttcatttctttttttttttttttttgagacggagtcttgctctgtcacccaggctggagtgcagtggctgatctcgactcacagcaacctctgcctcctgagttcaagcagttctcctgcctcagcctctggtgaagctgggattacaggtgcctgccaccaagcccggctaattttctgtattttttgtagagatggtaaaagctgatttctgtccacttacttgccttcctcctggtgtcaggctgctgctctgcatctagggacttcacaggtgcctgacgtgacataggggctctctcagctctcctgccctagcaccttgtgcactacccatgtgtatttgattaaggcccacaggaaagagttggcaagtggatgcagatttgctgtgttttggggctcctggagattctaatctatcatttcagctcacatggagacattaaaagtttgttaacagttcagctggtatcttcttacccttatctattggcagattctttgtctttccaccactttgccacagatgaaaacagctgtggattactactttgcctatgaaggccttcttgatatctgatacttacttcctgtaggtttctttgtgttctatccacattttctaaatcctggggcaaattgtctctgtgtaatgttatagaatggaggttacagtcatcccatgggatttgattcattgaggcaaagtggataaaatatttccaaaaggcatcatttctaagtggactggggagttcacaccttggctttgccacttagagctttgtagtagtattcagttactctctgaaagtactgctttgttaattggaggttaaaacacccacatctgtcatcctctttgggctccgaagattaaatgatgcagaagtacaaagtaaacttcccagggcttgagtggtttgactaggattactgtaggaaagattttgagatttacctttaatggtagagtgggcagtaaggtgagtgggatggatacaggatggctttacatttcctgagctgtctttacagcaagattatatttcatttcaaataaaagaagagaaggctagtggttaaaagcatggtctctgaaaaaaggttttctaggtttgactctcaactctattatgtactgtgtgacctggggcaagccacttcacttctctgtttcttagttcctttgtttgtaaaatggggatattaatagttcctacttcataggattgctatgaggaccaagtgagaggctaagaatgtaaagcagagttctggctcagcatggcaggctcagtagcagtgaagtacattgcttctcattttttcctttctggttgctctcatgtcagggcagggcagagacaatcctggttagcttttcatcccagcagagaattcagatacaaatcctgattaagaaggtgtatttagtaagatgtttcacaatgctcatgggagctggggtgtctccgttctgctgttggttggttagtactggaggccagatgttttagctcctctttcatgactttaatcttgtgttggattcatcaccaaaagacgaacaggagcatccgctctgcattacttattacctccaagaagaaacactgtcgcagcactgtagaatgttaatgtctcttccctacacaccctctctccacctctccacttctgtctttcctcctttccttagttgtgggaatgtggtatatagtcagggtgatttctttgtggcagggtagagatgattagcaatttggttctcttaggttgaaaatgcttacatttataggttatatagtagatagagccatgctgtgttgaaatctcatggttttgtgggtttatatagtgtattttcagcacttttaggtgcaataacattcacttgctttcagatgtattttaaaaattgctgattacttttgtattaagatttgaggtcattaattttaagcagattgataaaaatggtacttaatctctgtgtatttggtatgtgaattacgtagcatttattttaggaaatttccatggaattccatttatctcagcagttttgaggggagaagataatactgtagatgtaacttactggagtgctttaattttaattctgttgactgtctctgtgtataggtttattaccactttaatttcttcagtttactttgtatgtggagttctatagtcatttaatcattattcctgtgctcaaggttctacagagatgaggcctgcctttgggctcttctagactttgaaagaagcatcttgtcactggagtatggatgatgggggatgatggagaggataggggcagaatctggatcttggtaccctcctgccttcagggttgacagattcagctggcattttatgcagaattcaagttattaacagaaaactctacaagagcaaatgaagctttagttaaataaacatgaggatttcaaatatcagaatatcaactgtttggaatatctacattcctgtaccctttcagtgagtaaattggccataattatctttatttgtagaaaacaaagaggtgctggttcagggatatgtgatatattggccactggcctcaagcatgagttttgtcatttggagacagatcagtgctgccacctaacctcaaagaatgaggatgtggcctgtcatctgcatacacaaatgcaaagatatcatcacttcctttttgccaagagtgggctgagtaaatttgccagattgtggtgattgtgcttgtctgccgacagggagcatgttttgcttttagttgtccagggataataactgccggttattaaatgcctctgctaccttgctgtgttctttgtccataagacttcatcctccccttcacattttaaggggaggtatggttagctttatttttataaaaggggagcttgagactcaaacagtactaactcttccaaggtccagagcttttcgatggtagttccggggtggaactcagatctctgacccccatacctctgatctttcccctttaccatgcagcctctgggcttcagaaaatgtttcctacaggattatattggatgccactgattaaatgattactgctacttaattaattggagatagaatttgatgctagaaatgtttttggcaataatgagttacttaggtgactgaacttttacatttatttctaggaggtcattttttccttgtttttgttcgtttgtatcttctctcataaattgtagtattcttgtggcatgatggtgggccatttagttccctgattactttagatatagtgagttaggttttgactagaggctcaggagctttgaatgtagacatgttgtaaaaatggtactgctgtgtttgtcagttttgtttgaacacataggatcccctgtgggtacaggtttatgaatctctttgttatagtggccactattatactttatcctcagagagagaaaaagaaaaactgaagttatttgttgaattgcacatgaaatctttatgtcaggtttagtattatagaggtaattttgaaatatagtttgattttggagtatttaaaaattgtcatggtaataatgaaaaaaatacctctgcaatgcagtatttacatcttgctatttctatttgataatgtacagattttctgtatatttcgtgcacttatgtcatgattttcattattttctttgtccaaatgtaagactcaacacatttaatgaaactaagtggaaatcctgatctggttatgatctaacccgttggtatccaacagattgctgactgtgtagtattttagcccaggatatttgtcacctgatttttaagtctgagcttgaagaggaaggcgataagggcccatggggaggtaagagtaactgctgttggtacctctgttaaatttgtctttctcctgaaatagctgtggaagtgtggagctgcaggtataagctgaaggtaaaaaagacagcactattcttcttctggccagttgtagaaagctcagcagcttcttgtgtcggggcctgggtggtaccttttgtaggggttggactgtagttaatgtgaggacagattagaaaatctggtttcagagagcaaggtgaggctggaagttaaaggtgttccagcacctgaacaggaaccaggtgaatattcaggaatcaaggtaggtcaaatcaaggaaataaaaacacaaataactagttgtttggttgagcaggtgctcaggaggcaataggaagtcagagaccagggatgggatataggcatgggagaaaggcagagactcaaaccagtaaaggatataaagcaactttaagcacagttaagaaaacctcttttgggctgtgtgtggtggttcacacctataatcttggcatttgggaggctgaggcaggaggatcacttgaggccagagtttgagaccagcctgggcagcacagtgagactctgtgtctctctactaaaaatatttgtaaaaaactttaaaaaagggaaacctcttttatacttatttatgatggcctgtgaacaacttcaaggattttctggttggagacaggatggtggggccaaagctaagggtaatgccctggtttggttgctgaaattaaggaaagaaagacatttgtctaccaggtgattcataggtggcatgataaacagtagtttaatgtatagagttgagaagacaaaacacaggcctctgaaggtaaatcccagtggaaagtagcatgtgttgggtttcacactggtgatactcctagtgagttctgttggagttaggagggtggggtgatctagctaggttggtgtggtcctgcagccatagtgaagaagatagagtcagtcatagaaggagtggagtttggaataaaccttgggacttaggtgagatagatgtaggtgagtgtgtcttccacctgtatttactgtgtgattttttttggatgagtcttccattagactgtttcctaatttgcaagatagttaaactaattcctaccttgcaggtgtcaaggttgtaggggattaaatgagatgatttatgtgaaagccctttgtaaatggcactgtggattcagatgtaagttgttattaataaattgccagttgcaatggggagcctgttggataagagctttaattcattcatcatatgtaaatgaggtggtactctttgcaatcaaagctgtttaatgaaggtcatgattagggggaaagagtcaggcggctgtttttaagtaaggttggtgtatgcctgagatttcacttataaacttataaatacataattagtattgaaaattactgtttaatgtgcatccgaagtgctttgcatttttttggttgataaaaataaatgtatttgaagagtaagttactgaactataaaaaaaagaaggagtccatttagtagcaaaattacacgatgcttctcattctacattctgaaataggctatttttagcatctctttgaatcagggatgaattctagttatagggttcagtaattaaagcagagaaaaatacaaagtagtttgggcaagaaaatctttttacttgggttggatttgtttcaaggtttaaactgtcatctcaagggcctccctggaagccactgtttttgtaatctttgtggggtcaagagcaacagaaagtgccaaaagatcagccaaggacacagtgtcccacttttttagaacaggggagttttaaaacttctggaatcctggtatttcataactggtgatcttgtatctgtgttctctgcacaatcctggacagaggcgccagggtcctttggtctctccctgtctttcctgtcctcaggcccttccttctggtcagtgcttccaccctcaggacctctgcccctctgtccagctgccctgctggcccctggttttcctccagttctcagtctgcctttgagtattgctaaagaaaactgcttaatgatgcccttggtaccagtccacatttgtatttaatgatggtagattattcagaatgttgctgaatagcttctttacttggttctagtcagcagtctttgctcaagctggaagccttgttttatcatgagaaagttattattattttatctttttatgcccgttacaaagaagctcattaactgtttggtggagttgaaacaactgttgattcaaattctcatgctcatgcttgtgtggcacttaaaagtggtgatcacagaggcaactcagggtcactaaatacggggcaagttcagcttttctagttgaagtagattaggaagatgcatttttttttaaacctctgcatttggggaaaaaaaataactttcacaaatgtttttgagtgttgtctatgtgccaagtattgtgccaagtgctggaattaaaaagaaaaagatttgtcacagtgaagaatggaattagggatcaaagtattaggatccacaggtggctgcccggggccagacctgtctactgtgaacattaaaaaacgaagcttaactgttacccgaaggcagaaacatcgattagataatcgagttttcctttggaaaccaattatatttactacggatttctaaccattttcaacctctaaatttttttatttctagtagttcactttttgttgtggtaatgaataactaggcaaatgcaagagtagaactcaatttgaacttaaatcatcttggttttaggtttttgtttgctcatttgtttactatttgttttgttctgaatccacattgattgagagggtgccatgaattcctttctgtgtgaaaccctgggattggtactgagatgcagtgaacatgccccagctctggtgggttgttcaggctggtggggcggcacctggtggtgcagtaacagtacttggtgctctttattgcttgctaaatgaggtagacggctcttcccatgggttagctcatttaattctcacagtctaatttttgtagttagggaaacttaggtttaaataaactgctcagagttttctgtagcctcacaggagacagacaggtggatacacacacactttatttcaggagcaagttctccatctggagctgtttgactttctcttttttcttttctcttttttttcgtgtgtgtgtgtgtgtgtgtgtgtgtgtgtgtgtgtgtgtgtgtctgtggcggggacaggatctcactctgttacctaggctggaatgcaatggtgtgattgtagctcactgcaggcttgacctcccaagctgaagcgatcctcccacctcagcctcctgagtagctggaactacaggtgtgcgtcaccatgcccagctaatttttttttttttttttaagatacggattttgccctgttgcccgggctggtctcaaactcctgggctcaagcaatcctcttgcctcagcctcccaaaaggctgggattacaggtgtgagccactgccctggccctttgactacctctcgtagcacaatatttagttggtgataagagtttatcttcatgttgactttgtatactctttgcatctcaaaggacagaaatcagtctcttggtgtcactgttcctctcttgtttactgcagctggaaccagtcttctgtcgtagcactttccatgctcagtagtccccccatatccgaggtttcacttaccgcagtttcagttactggcagtcacctgtggtctgaaaatattaagataattttgtgcatgcacatgagagagagaccacattcatgtgacttttattacagtatgttggtgtaattgttctattttattatgagttattgttagtcttactgtgcctaatttataagttaaatgtgcctaatttataaaataagttatcataggtatgtctgtataggagaaaatttagtatatagggtttagtactatccgcagttttaggcatctgctgagtgtcttggactgtatacctctcagatggtagggagggttcctgtgtctctccacttaacactttctagcttgtggtgtggtattttttgatataatgctttacgtttgtgtgattcatagttatatttctaatgcctaatagtgggctagtgtcaaaaggcaaattaaaaatctaattaaaaataaagatctaattggcttttatttgtgattctagcattgaatcgtacctcattctgtaaaacaggatgggtgttccagtgaactgaggagaggagcttggctttataggcaaaaaaaaggctgaagaaagcagaaataaagaatgaacagcagattggtcatttcagaattactttccttacagggttaaaacagaggaaacttttcttattatcccagctcaggtaaactgggcctcttctgattggtggccatgaatctcttatttttgttttttgtttttaatagaaaactggcttgtttcagagcagttttttgttttgttttttttttgaaacagggtcttgctctgtcgcccagactggagtgctgtggagtgatctcagctcactcactgcagtgtcagcctcccgggctcaggtgatcctcctgcttcagccttctgagtaggtggaaccacaggagtgggcccccatgcctagctaatttttaaattatttgtagagatgaggtctccatgtgttgcccaggctggtctcaaactcctaggcttaagagataatcctacctaggcctctcaaaatgctgggattacaggcatgagccaccgtacccagctgagttcagtttaagtggtagttaccacaagtgattccattctggtttggtgtggtctactggggcctagtacaggagctcagtccgaaataatgtacccctccccacccccccgtcccccttaaactgtgttgaacagtagtaaatgcttgaatgaattgaagagtggttgatgtggtccagatcgttgcctgggttatcagattctctggcgagggactgttagcccagaggtatgggccactcatggatctttacaatgccatatcaggcatgggttcctttttctttgtattttactaggcagttattcattaaatggaagagaaagaaaatattatcttacgattcttgtatttagatctgtggtaagtaatttttgagtgaataaagtactcaaaactcagagaatttctctttatttgctctctcttagtataattaatacagttttattgaaattaaaatgcacctagctgagaatgtgatacacataggtgttcagtgaatgtcagctaacgttatttttgttttagcttacagcagtatctcttctgctacttgttttgtatttatttatgtttgtttactcttccccaccagataaactttctggggggcaaagaccttactatttgacattgtttttgcctcactttctataagaggtcaattatgtgttgaattgtatggtggggccagctaaaatgtgttcatactggctctgactttaaaaggtgcggaaccgttgtagcaatggggtatcgaagctcaggtagtcaacctgagagaccaagaaagaggagaaacacaaagattgctgtcttgttatgctagacatatgctttttgctaaaaaattcatattcgacattcttacgagatatatttctctgaatctaggagtggttacatttctatagtgtcttgcaatctcataaatagaacattatacgtgaatagttaaaaacattgatgatgtgatctcatcgatagaagtgaaaagaagaacatagaatttcagcctggtttaggaggtaaggctggaaaaataagtggggaaatagagctatatctcgagctagcttctcatttctggaaaactagaatttggaggcttacaagagatgtcagggaccaaaatagtaaatccaaatacaatcagattaggataatattgatagattaacaatgagtcatttagatacaacctgttctcaggttaagtgttttcatgtagcagaattctttatttcatattgattttggatgtcgtggataagtaagattaaagggcgtattactagggaaaattttattatcattgaccttgtaaaatgccctatagtacagaatgaggtatcatgagataaactctgtcatttctctcatcagactacagagaaatgtaacctgaatgtgaagtgagctgctgacaaggtgaatggtctgaaagtatttgaaattacctgcactcatattggctgtcataacgctgcatggtcccctcctcctcttcccctcttctttttagaaaaagactttttttttttttttttaactaggcagttatttttcctggcttgacttgtggtctgtgattattctctaaattgtgacttccagtggtttcatgatgtcatttttcttttcttttttccctgaatggtataaataatttttatttagtagtagtagtttaatacttaggcttagagacagcaggattatattttgttgctaccatattgaggtcattatttggaacctgagtgaacaaggataagtacatctgtgatgggattttagcggggagaggtccttaaagattacccagtctgttcctctagtcagtgatttgttcatttattcaaatatttgagtgtctatatgcttttctttgcagtatttcttttcccagatgttggtaataacaccttcagtacaactatctcaagccaaaaatcttagaagagtactgtccaacctagtagccactagccacatgttactatttaaatgaacattagttaaaatgaagtaaaatatggagttcctcactcacattagcacatttcaagctggatccatgtggctggaggctgccctctgggacactgtcactgtgtagaacatttccatcactgcgggacattcatttggacagcactacctcagagcactccttgactccaggggagtcagcatccccatccccatccacttaatcttccgagacctacgtctgtcagatttgttccctttaaagaatcctcccttgtcttagtttaggtcttcatcacctgtcttctgaattatggcttaaattcagtgaccagccttgtgaagctgtccctgccgttgcccctccagctgtagccaccttctcccttgtgctctgtgcatccgccatatacacctgtcagagcactggccccacggaatgctacatggttgtttacagacttttcttcttgtggactgagaggttcttgggagtccagggttgggctttggttttaccagggggaggggcaggcacagtgactgacacataactacatatatatgtgtttattgagcaggtagaggcatggatggatggaggccatagcaggttgcagtttgaaggcaagagacctttggatacctggaaactagacgacaggagggcatttgtgacacagggagtgtaacagatgcaaggccagaggtaggaagttacagggcaattctgcttctggacagtagccacaggagagcactgtcagcaccattcagagtgtagccatgtatggaaatagaattggagtgatggtgttgcatagaagcatgcttccctgttctggccagtattgcagctcgtagtagaggtgctgtgtttccacttagcagccttaacctgtgacttcaaaggagttactgatatgctctccattgtcaaatgaggctacgtattcacaaagtctagttaattcttcaagacttttatggttcttgacttatgttagaaatgttagcagctcagcagcaaagaaaaaggcatgtgtccgtgcccaaaaggagacaatccaatgtagatattacttacttactccttttttttttttttttttttggtagaggtggggttttgccgtgttgcccaagctggtctcaaactcctgggctcgtgatctgcctgctttagcctcccagagtgctgagattacaggtgtgagccacaccgtgcctggcaagaacagttgctttctagtcagactcatcctgactcttctttttcctagctgtgtgatcctaaaaaactcactttttgatcctaatttcttcatttttaaatggagatattacctgcctgtgaggactaagttaaatgtatatgacatgttagctctatgcttagacctgagtaaaacatttaccagtaatagctaataacaaaaataataagtccatagcctttcacacaaatgggaaaattcataattgtgtttcacaaaggaagagttaacacgtgattcttaaacataaatggtcatccagaaaatacataggatgttggacattttccttgtccttaggcatagttagctggatataaccatctcttaagtgaaatgtatagggctggttaccctcaaaatcatcaagtcgaatcagctgatctagtagaggtaaaattaggcctgggtaatctaaacccagggataattttctgtatttggaaataaggtgatcacttatgcagattacttaggaaaaagctcacttttctcttttactcagcatcaagagcatgcagtacagctgctctgaaggaagagaagaaaattgtgtgctgctttagttttaaataagtaaaataggatgtataaaatggagtatcgctgaatgatcattctattttttttttttgtactgttaaaaggatggttgcggtcttaactatgtgagttcttagaatctactggcctacatagaattcatgggggtccagataattctttttagtagactcaaagttgcttttcttccataatgaaatggcacagttatctgttttctcatgcctggacctcctttcccaagcttgatgcctcccacccttgtttgaccttcctgaagctgcaccccgccccacttctgggccgctgttctctcgctttcttgcgtctaccttgtattaaaattatctgcatttatttgttaccctcacaagactgagtaccttcacaaacaggcattttcttattcatttttatgtgttcagtgtttaaagaggggctgacttctacaagatgcttggtacagtcttgctgagtgaatggatgcatgttcactaaaattttcttgtatgtattcttcccaagtagaccataattctgagtaggaaaccatgtcatgcttcttgttacctcatagctctagcacattggtatacaacattgatcagtttgctctgtagcattgctgttaatgtccagtgtcctggaaacaccttctagggcgtatttggcagttattaaatctgttactattttatccctgtagctactattagaatatttataaaatgatctccaagacttttattgaatttgaatattgttatgggaaaaatcgatacaaatgctcttattagctacagttcttatgtgaatgattactattatttgattcagtctgtaggcagtaacaaaacctaaaatatatgtgttgttgagtaaatgaattgagcagttcagttgaatacacttagacttgactttttctttttctgcccttcagctattatttactgtgagtccttgaagttaatttcagaggtttttcaggatagggggttggaattatacaggatttcacacaccttattagctccttacttaaaataattaaaaaagaactagttcagggattagagctcccttgaaattgttgaaatgtgaaatttgaatttaagactttcttgaagacttgaatgcattttgcctactggtaattaattttttttcttttctttgtagttttagttttgattgctgttaactactactgataactgagccaaagtggtgatgctacttgaggggaatttctgcaacccatagtcaacgattacatggtaagagtgtgtgccttttacccttaaagccatttaatttctgtaacatagtttagaaatttaattagaaatagaaatagcataaaatattctaatatttttgaatattaaatatttaatattaatatactttaatatataaatattaacagcaggtaatattttagagctttagatcctaattaatagtttgggacattgaaagagaaaaaaaaacttgatatattcacttccatgttaatttttttgtgtgaaaaacatgattatgtagtttatgacttattaagctgagatctcagtcttcttacctctgtttttgcccatttactttttatttcctggaatttaaccaattctttgttatctgaatctttctagtaatgaatgggtatgagaagtcaagatttaaaaacttaaacctaatcagttggccggacacggtggctcatgcctgtaatcccagcattttgggaggccgaggtgggtggatcatgaggtcaggagatcgcgaccatcctggctaacacagtgaaagcccatctctactaaaaacacacaacaattagtcgggtgtggtggcatgtgcctgtaattccagctgcttgggaggctgaggcccgagaatggtgtgaacccagaaggcggagcttgcagtgagccgagatcgtgccactgcactccagcctggcgacagagtgagactccatctcaagaaaacctcaaaaaaccaaaagcaaacctagtcagttttacaataatttactctgaactgaggtggtggtgatcgtgatagtggctaaaatgaggtttttgaattatttatggatttcagtgacctgtcttactctaattttaaggggtaattgaggagcaatgagacatagcagactagtagggcaagttatttctttgagcttcactttcctcatatgcagaatactatcatctgtcttgcctgatttatgaaactgtaaaaatcaaatgagaggatgtatatggaattttccttttctttctttcttttttcttttggaaggatagggagagaataacacgtcttttggttttaagatgatattgaaagagaacataaggtagaagaaaggctattataccagaattagaagctggaagattgatctctaatcctagcttgccttgaccttgggcatatcattacatattaatttaccataggaaaattgaacttgatttccatactttcactttacaggtaatttttcaggaatgtatctgtgttctctgaccaagtttaattaagctagaaatcagtatcacatacccaagaaattccaaaatattttgaaattaatgatcacagcctgaaaatccatggttaaagaggagcttacaaggcaaaatactttgaattgaatgaaaaggaaagcgtaacgtatcaaaatatatgcgatgcacctaaagcactactttaaggggaaatttatagtgttaaatgcttatattagaaaataaaagttaaatagcttttgggcttttcctgtatgtcatgatgggttacaggctgattgtagttctgataaatggtttctttcacttcctatccaatttatatgaaaaggggagatagttaaatttttttgtcaggcaagcatttattttttaacacggatactgtctagtatttgtgttccactttatagtttttggggggctttcaggtgtgtcatctcaccacagccttttgagataaccaggcagatattactgctttcatatttagaataaggacttgaggcttatggaggtctcagctcttgaagaactcggggcttctgcttgccacgccatctgcttgttttgctgctgtgctgcatttccaggctttttgtagaagcgctgtctgtgttcagactgttgttgtaggtggcacactctgattagcttggtgaggcagattctgttggatgagggaattctctaggaggagtgctttttcttaggcatttccgttggtgtttgtattatgcccatcagaggtggcctttttttaagtaccgttttggagctatgtctatctggttgctaaatgtgtctttcctgtctcatttcttttatcatgatatttagtcctgtgtgtggctaacagtcgacttatttttacttgaccttcatgttagaatgtacatattaaataaatgttcagtgatctcctactttgtcatactcagattatctgttgccacagatttgttttttttggtttttgtttttgttttgatttttttttgagacggagtctcgctctgtcaccaggctggcaggcagtggtataatctcggctcactgcaacctctgactccctggttcaagcgattctcctgcctcagcctcccgagtagctggggttacaggcatgtgccaccatgtccagctaatttttgtatttttaatagagacagggtttcaccatgttggccaggatggtctcgatctcctgaccttgtgatccccctgcctctgcctcccgaagtgctgggattacaagtgtgagccactgtgcccagcccacagattcatttttaaactgctttattgtggaataattgacatacagtaaactatgcttatttaaaatgtataatttgataagttatttgaaatatgtatacacccatgataccatcaatgtagttgaactggtgaccgttgtttcctcatggcccttggtcatttttcccttttgtttccctcctaccctcacataacggctgctctgctttctgtccctatagataagtttatatttcctagaatgttatgtaaatggaataatacagtatgtagtattttcgtctggctttcattcagcatagagattcatctcttgttgttgcatgtatcagtagttcattccatgttatcattgaatagtacctcactgtatggatgtaatgcagtttgtttgtccattcacctgctaatggacacttggattgtttctagtttttggctgttacaaataaagctgcatgaacattcatatacaagtctttatgtgggcacatgcttttatttattttgggtaaatatctaggagtagaatggctggatcgtgtgataagtgtatgtttaactttttaagaaacttgcaaaccattttccaaagattattttgtttctcttgagcagtggatgatagttccagttcatccatgttctcataagcactctgtatgaacagtctttttaagtttagccattctcatcagtgtgcagtcatatctcctgcggttttaatttgcctctccttaatgactaatgctgttgagcatttttcatgtgcttgcttgccatctgcataacttctttagtgaagtgtctgttcaaatcttgtgcccattttaagaaattgggtactttattatagattttcaagaattctttatatattctgtatcagatctttatcagatatatgatttgtagttttattcattttaatagcattttttttcctttttaccccagaatgaaatttttgggagccaatatgggattattttttggttttattttttgcactttccccaactcccataaaagtagttactctttgtcatcttccttttcttccattttctggcagggcacttagtttgtattctctttttggggggctgtacatgagtcaatagctgtgcaggacagaagacccctaattagtgaatatgtttgcatggctgggatggtcagctctttatttctggaggttggagatctgccattccaattgtcatcagtattgactcgttgtccctggggtgtagtcaaaggcctcacctgaagtactacaaggtcagaagccagaacagggccagattcagattcaatgatgaaaatgctggcgacaattcaccaacatcccttgatttttacatgttcatttctgattgaattgtattgtgcttactgtgtgattgtaattttctgtgtgattgcagttaacttttttgtgtgacctaattcatagctttttttcttacaacttttccgtgttttcttttttaaatatgcattctcacatctatgtataacatttttaaaaactatcaattaacacttgttaattgtattattcaaatcttggtctttgttggtttctgagaaaagtatgttgggtcttctacaaaaggataataaaagttcataattgtcatttttagtgttttttttttaccaattgaatatgataagtgtcttcccctccatctgtttttgttgcgttcaccttgagtttctcttgtgtcttagagcctgactcccttttgttgttagcatttgcctggtgtatatttttaatctctttatttttatcactcctagttatttcattttagatgtattcttgaatatttatcttacaaaacccaaacaactcagtgtgttgctgctttgttcagtggaggctgtttggtgagtggtaaggacatggactgagtccaggctgcctggggttgaattcaggcactgcataaactggctgtgtggtgtctgtcaagtttacttaaatattagtgcctgtttcttccctatacaatggaaatattaatagtttctatctcattttataagaattaaatgagctaatatatgtaaaattcttgacagtgcatggcacattctataagtggtttggctgtgttcccacccaaaatctcatgttgagttgtagtccccataatccctacgtgtcaagggagagaccaggtggaggtaattgaatcatgggggcagtctcccccatgatgttcttgtgatagtgaattctcatgagatctgatgattttttaagtgtttggtagttcctcctgcattcattctccctccggctgccttgtgaagaaggtgccttgcttcccctttgccctccgccatgttggtaagtttcctgaggcctccccagccacgtgaaactgtgattcaattaaacctctttcccttctaaattacccagtcttgggagtatctttttagcagtgtgaaaacagacgaatatgaagtcttagccattaatagtgagttcacccattaacacttactgtgattatttggaaggccatagtcactattagtgcctcctttttgttaaaaaaattaatactttcttgtccattgctgactttattacaattttttcctgtaatggtttgttatttatatatccagtatcttctagttgtttgtacgaaatcaaaatattgatcatgcagataacacctgaatatatacgtcttttaaaaacttgcaacacatttgcaattaaagtaccttttgagtctcagctctgttcctcctcccttagaataataaattcattattatgaatttgagacatttccttctctgacacacactctctcgctctctctctctccccaccgtctcccccacctccgcccccccgtctctttcatacatgtaggactacatagtactttttactaaatggcatactgtaattatgaactttgtatttttcattcactgctatgttttggaggacactccatatatatatttatcttgtttcttttaacagctgcctttcccctattggtagtcatttccagtttatctctatgtcaaacagtgctgctgtgaacattcttgtacatgaattctgtgcacaagtgagaatgtttctcagaataagagatggaaatgctagggtccatagtatgcatattcctagttttattagatataattctttcaaaggacaatttgatggttggctgccatttgtatttctctggtgtaaattgccaagatcttttcattgtggttctccaaccacacatctcgtggccacagtccttcctgtcatatttttggcttgtggtttcttcctttaatctcatcccgttgcctttcaactttggaggttatctatcatttgtagtcctgtagtattgttgcacatattttaaatgtacatctttttcatcatttctgtgggtttgaaacaaaggagaagcctagtctaggtgctctgtttattatattctatttctataatcttccatttcaaattatataatttttgaaaggatttcctatgaatgagctaaggttatgcacatacatgccatacacaacctgcttataagtgtctcattttaatggagaaatatgcttagcatatgctgcagccttaaatggaaagtagattacatttaatcccaaatcaaggaaatggagattgttgttcttccttgtctgaaatgtcaccttaaactgctgttttccttagtttacccacagcagcatttctgtaagtctccttggaggctgggtatatattctagtcttatgcacacagcttcctggcagacatcaaatggaatttgacttaccagatgtcgtactgaatcatggtctgcagagatgcggatggatcacatccttggctggggaagtggggtggatacaaatatctgggtcaactcagtggttaaccaaaggttagtcatgttataaaaagtcatgtatatcaaaaatacaaaacagagtaagatagggggtctgaagcttatgcatgcaatcagcaacaaggcagtgtcaggagttgaaggaccagacaaaaccatctgtttaataagataataaaatctgatataaaaggaaccttggaaatgtaaaccacctccttcctttttggtcagagctgactcttaatgacaaatgatcaggtgcttagagggttaagaatggggagggacctgctgggatagagggaaagagaatgaatagaagcatcatattagaagtcaaggattacttgaataccaaagcagacaactttcccctccttggctgcctttttatcctggtaagacacagaaatgaagtagccttggcttactggcatatttataattgggacctgtaggaagcgtttacaatggggatgtggtgggcagagcaccagtggaagtgagagaccgagattctagtgtctactccaggatgtaggagattttgggtctctttgtcttaatctttgattgtaaaataaagttatgctagatctccaaggttccatttatcttaaaattttttttattaagtagctgattttgtctggctgatcaaaacagggaagaaaaatagttcctggtcaaagcatctcggaggttcctgggttaataatgtgcatcagaataaatttttatgcacaataaaggactataaaacagatgtaggttcaaatattaaatgtattcttgaatcccacatgttctgagtatctagttaaatgaacaccatggtctaaaaggacttagaaataaaatatgggtatattttaaaaatattttttatctaataggaatttagtgatttatttaactttaaaaagtctgaattaaatgaacataacacagagcataaagattaattgaagcatagatatgtagagcgtggcaagttgtagaacagcagcttttttcagagctccctttaccctgtccatggctagaagagaaaggcagggagaccaaaggcttgatcttcacaggctcccacaccacttctgtatccccacccatgatacgttgttcttcacttttactccgagatttcttcccacaacagagaaactgcaagacaggagctaatggtgaaaaccctggtggagagaaatcttgacctagacttcaaatccctaccttttcagttagaaccatattagcttctacctggaggatctttatatgccattttgtggcccttgaaagacaaactgtgtcccagaatgtcctctaaaaataggtacttgacaaggtttttcattacattattccatagacacaaagttgcctttttctgggagacttattatttagttgttgaggctgtatagcaaaagctaagtgacgttttaaaatggtggaatgctgcttctaagccttgagtgagagcttcactcttccatcctcaaacgtctgttgaatagcttcccgatgctgagcaggatgctggggggtctgtgatgccgtgtcatctcccattccccactgagaatggagtatttctagttgcgttttaatttccaggaatgagacatacctttaatgtagtgcttatcacactgtgttgtaactttatttatatgcctgtctctgccactaaaccattagcatcttgaggaatggggtttgttttattttcgtttgttcagtttttgcatttccactagctaaagcatcatgaaaacacactgaatgtttggagagtaggtgaatctgatatggtagtttctgaaagccagctgaatgtctaactgaaaaggaaagtatgccagagctggagggaacccaagagagcaaatctgttctgcaggagaagaaactgaggcccaccctgatgaagaaactgaggcccaccctgatgaagaaacttgcacagagtcgtgtagtgttagtggcagaacttggactagaaccccagttccccaattcctagtcctttgctgcttcactgtacctctctgtctcccatcctgtggaaacatacagaccacatttcaaagagcaaagtgtgaacatttgtcccagtgaaatgaggttgattgaattttatgtggtctttcttccttccctccccctaaatcacaacttttaataaagctttaaaaagaagcagtgtggctctagaaggcagtgtgcgaagtgaggagtttaggaagctgaggcccttcctttggcggtgggaatgttatgttagtgagtatcttttgggagttgtcagtaggcacttaactccaagcagagtgctgtaaagtggaggcaggcagacatagcccttgtccttcaaaatgagaaggccacactgaggggaaaggtcagaggaagggcttgggccagcattgtgtcactctactctatgggccctggctacttttgcttgggtcactttcattccgagggcaaaactcatacatacaagtaaaacatggttaaaaagcccaacatctgcagtatacacacatttagttttgtgtgtataatatagtctgtgccacatgttttagtgctatcatgcactgtgctctaattacctggcatgcagcaatcagagcaaaggttaccagcacatagaagagagaatcattaacactgtcaggttctgcaaactggttgttctgaaagctcaaaggtcagtctttaatggctgcatagtggagaaagaaatccactacaaaatctattcagttaattttgtatagtcaactacctctacctaccagtaatatcgttttaaaatatgtaataaagacttaatgcagttaacatgttactctacatcccatgaacccttactgcggtggagaatgaccacagttgtgggcttcagtttatttgccccattacagtgtattctatgcatgaaagctgttatccatgttaatagagtagtggtggtgttcttttctttccagaatagtctgctctctttggggtctgcacacataaattcttaagagtgtactcatatgttcactcattgagaatatcagtttacttagctggacgtggtggtgggtgcttgtaatcccagctactcgggaaactgaggaagaagaatcacttgaacccgggagatggaggttgcagtgagccaagatcgcaccagtgcactgcagcttgggagacaaagcgagactccgtctcaaaaaaaaaaaaatctgtttactgtttctttctttttttgtgaaaatagttatcagctcaatgtcttaacaaaagaagaagctgatatgttacccttgttcttactgtgaaggtggagtttctcttccaattaggatataagagaacattgcttctattttaagaaacaaaaaaggccagattatctagaaagcaataacttttcttaaatcccaaagggtgacaaacccatctgagagtagacaggacacttgaactgtttcacatttagcagagcacagggggaacaggtaaccatcatagaagtgcataagaagaattcagcaaaaattgtaatgcattcttaaggttgagtatgggctaatgcatcagtttaggataaccaggtaccccagatacaaggggaaggttacacttactcataagctgttttctacagccctccactgggtactcttaagaaagcttatgagcaagcctggagactagacagaacctcttttgatcgtgctgctctgcgggaggtaatctcagctgccactgggagacaggcatgatgtaacacctgcttccccacagccttctctcctatgacagagttcccaggagggcaatgaaacctctagcccataggactcagcaaagatctatttctggcagaggtttaggaaaccctctttcctgccctgtgaccagcaagatcctctgcttctgggacgaagggtaattaatagcaaaagcaggacagactcttaggctcataatctttcactgatgcaaagcaaagttctctttctgctgcatgagggacaggaactctttcatgcccaagacagggacaaatatcaggcagagtttagttgtgttggagaagagatgcacagatcctgagaaggccccactctgaggtccaggtatatggatcattcctaaaatttaggctgggccagggagagcaaggagcctagcacctggtaacgtagcaataacagtcatctctggagagcaagaatgtaaagaggaatttgtgtcacctttgtgacataaatgtcaaggaactacaggatgatcaggaacactgaaaaaagtctagcacactaggcacaagacagcagcccatggctaggggattttgatgcttggtgtatcagataacaatagcagccatctccctcaaaccctgactaggttgactcaatcaaccttagtaatggcttgctagaagaacatgtgaattcattgctggacaagaaatactgtttacttagtctctactgctttgcaaatgatatccagcattcagcacaaaattatgagacaaaaaaggcaagaaagaatgacgtgttgtaaatcaagagataaagcaatcagcaatcaatggaaacagactcagagataacttagatatgggaacttaaaaataactgtgattaatgtattgaaaaatgtattgagaaaagtctatatcaacagaaataaggaaacaagtttttaagagttaaatggaaactgttggaaatgtaaaaacaaattgggtttattagcaaactggatgtagctgagaaaataatgaaagctaaatcagcagaatataaaaaggaacagtgaaacaaaagaagaaacaaggaaagaggaaagtggagtggggaaggggagggatgacaaaaccgagcatctaagaactatggaacagtatcagtagtctaacacacatgtaattggaaacccagaaggaaaagagaagatactgtccagaaaaaaatactagaaggcacagttgctgagaattatcccaaattaatgaaagacaggaaacaactaataagacaaacagatccaagaatctcagagaaccccaagcaggatttttttttttaagaaccctccaagttctagaaacactggaatcaagttgctgaaatacccaaggtaaaggggaaagtcttgcaggcagccatagtttaaagaaaatgaaacattacaaacagaggaacaagggtaagaataacagcagacttcttgtcagagactatgaaagtcattaagacagtgaaataacatttttaaagtatcaagagaaaaagctcaaatcctgtcgatgcataattctatacccagcaaaaatatatttttaaattaaaggccaaataaagaatgtttcagacaaacaaaagctgagggaatttattgccacagatctgcactgtaagaaatgaaaggaagttcttgggcagaaggggcatcagatggcggttgggatctaaacaaagaaatgaagagaccctgaaatggtaaaagagaataaatatgttatattttttcttatttttaattacattaattgataattgtccagagcaaaaacaatagtaatgtggggtttataagaggtaaaatatatgacaacattggacaaagcatggaagaagaaaatggaaatatactgtttatattagggggtctccagagaaatagaacatataggatatatagatttatgaggagatttattatggaatttggctcacacaattatggaggctgagaagtcccacaatctgctgtctacaaactggggacccaggaaagccagtggtgtaattcattgtgcctagctgatggtataactcccagtccattgccaaagactcgaggacctgggattgggaaggtggtgcaggtgtaagctttggagtctgaaagcctgagaaccaggagctccaatgtctgagggcaggagaagatggatgtcccaacttaagaagagagagagagagagaaaattcatccttcctccactcttttgttctgttcaggttctcagtggattggatgatgcccacccaccttggtgagggtggatctttttttactcagtccactgattctagtgctgatgtctttcagaagcaccctctcacagactcacccagagataatgtttcagcagctctgggtatctcctagcccagtcagcttgacacataaaatgaaccattacattattctaaagttacagtgttctcacactatgcatgaagttgttcagtattattcgaaggtaggtgtgataagctaaaaatgtatatatctatagtaagctctagagcaactactatgaaaaacgtaaaaagaataaaaaccagttgtggagatgaaatgacatcataacaaataactgaaagaaagcagaaaaagagcttttggaccaaagaacaggtgggacaaatagaaaaccactagcaggatgtgttaaagaaaaaattatttaataagacttgttaaagcatggtaaagacttttattcaggaccattgcagaaggtagaggagccactgcaacagcatcttgcagtaggggagagagattgggttcaactctgaatacagcatgggcaagtggggacttatagccaaggatcagtgagagggtcagtggatggaaaagtactaagaggaggacgtcaggggttaggagaattctggctgacgcctaagaggattcttgctgaagatagccagggtgatgcgatgtcatctgggggatggtggacagttaggaacctgatgagatattgaggataaacaaattttgaggatggcaaggaatgttcttgctaaacacatttagcaggggtctttgctagaaactgaattttacaaagaaggtgcacagatgggcctagcagaaggttcagaagcctgactgaagtttggccaagcaaagaatctttgtcagatggaaggtttaaattcagccacatcaacaattacattgaatgtaaatgatctaaacaccctagttaaaagtcagagattgtaaaattggataaaaaagcaacacaaccgtatgctctccaaaataaattctctttaaatacatagaaacagaaaggttaaaattagaaggaaaaacttgtaaacactaatcaaaataaggaatgaccgttatatcaaagtagactttggaacaaagattattattaggggtaaatgggacattacataatgataatgggatcatttccccaagaagacttaataatcttaaatatgtggctacattcaacaacagatctttaaaatacagaaacaaaaactgatagaactcaggggagaagttgacaaatacacaattattgttgacgtcttcaacaactcctctctgaggacagtaggaagtaaaattcgctacccagtttgctgtaaacacatataaatgctgaatagagtataaccaagaaagtagaaagtagaaagcacattgatatgattttgaaattctttaatcatttggctttaattggaagagtaccaattggagaagttcagtgccagtattcaggcatttaattgtacaacatgtaaaattagaggagaaatttaggtttagattaattgcatgagaaataaaattagaggacaaatgttagtatcttattttggtaatataaaattaattaaaattatattactatcaacatcttatactatacttttttttttattttcatgtgagcctctcaacaacctgtaaggcaggcagggaaggtgtaactagtattactgcacagggactcatggagttattttgatagggtaatatataaaatcagaggtggggtgtacatttattgctgtgcatgcaacattgtctaccccatttcctgtaactaatatcctcaatatctatctggttctttgttttggtttttcacctatacctagtcaaagtttatatgtgtcactgtttattcattcagaatacatttgaggatacattggggtgggctggggggacgtgaaatgtggtaggtgttgtagtaatgaagggacaattaaaacgaaggctaagaattcttaagagaatcctcgcaaatggcagtaggaagtaaaattagctacccaagttgctataaacacatacaaatgttggatagagtataaccaagtatgtgtgtatgcacttatatatgtatatatttatatttaaaatagatatacctaatgctagatgacgagttagtgggtgcagcacaccagcatggaacatgtatacatatgtaactaacctgcacaatgtgcacatgtaccctaaaacttaaagtataataataaagaaaaaaaaaccctaaaaataaaataaaataaaatatatatgtattttaaaacattgccatgcttgaacgaatcagcaatcttccctaggtgttaggagctgagagagttggagggaagatgcttagagctagaggccagggtttaatgctgcccgtacatggaaatgtgtttcaggccaacctgatggaatgagctagaactgagacctcagaataaatgctgggatgttcaaagggctgtcaaatcccgtaaaagttgggtagaaaacctgcgctcgccaatcctgagaaatagcttgccatctgcctggggctccaaatagtaagaaaacaaaacaaacaaatgtgttagggagaaattagaaccacagtcttggccaggggcacagcaaaagaaaacataaaattgttctacaaggaaacttttctaaaacaaggtgcagagaacaaccccctacccccaccatgagaaagagtttgcagtaagaggttagacacactagcaagtgtcagcaggtgctgcacatgtgtgagggcacatgcacacagagaattagcacagcaagtatgaattaaggtaggtaattaagctacctggctcctcccaggaggagatgccaaggtaggattacaagttcaaggatcctgaatggatcacctgggttccttcctgcctcctttgcatgaacacagtcttacctcttcctgctggctggagtcagtttcctctgccagtacggagattcctcttttcattttctattccatggtaacatgagtccaaagtaccgtggtggcatccagaacttgcagttcagtgggatctttgccttgttcctgctaagtgtgtgccccatttcagacccccagccctgcagtgtccactggtgcagaatgggaagcacaaagttcccctgggctgttggtggtgatcattaagtagggcttttcttgcctccagccctaggcgcctaagcccacatgtcctcctccttgggatcccactgccatctagaggcctctgatgtataagtgtactgtgttgtggagtatgaccatcctttcagagtgtctggcaagcttgtgcttcagtgtgccttgaaaaggctggcccagcgttcattgggatggacccgcgttgggtggtttgatatgtgatgtgaccattggatcctgtcgatgggcccacgctcgacgtccttcactgtaaagtgggtcccctcgtcagatgcgatgatgtgtggggtccatcaggctgataattctgggtggacttatcgatgatgcaggctggcggattttgcctgctttgtgttcagtgtctctttggtgggaaactttccagtggaggttaacaagtgatacagaaatcttcaccctgtgcccactcccgaatttctacccacatggcctttatccagatctccttgttcctcatcttccagttctttttatttcagtaccttgaccatacaaccaggctgttggccactgcccacacatctgcacgcatttcagatcaagctacgcggtgtcatgaactggtgtcctgcccacagctccacctgctgggaagattttcctttccactgtctctgagggccatcctgagtactgctgcagcacacacagtccatttttgactaacaccatgtgctgagctgatccgtctgaaaaaccaagctcaggctttccttcctccttcccctggatgtatgagtctgctgcctgtgtaacctaggcacacaggggaggggcactacagctcttgggggtgacttggaggtctgggcttcctgctcatgggactcacttgtatcctgtggttctactgtggttcaatcttgaatgtcccatttctattttatggtcaactgctgctagtttgaattaataacttgactgacagaacttagctcattctggggagctttgcatgcctggacccctggttctctgtgatctctaccaggtcttggtaatatagtacatttaatactctgatgtgatggcaggtcctagggccttgcctttgattctcctgctggagcttgccacaaactccatattgtcctgttttccttattttttaaatttttcttttatttttatttatttattttttgagtctcagggcatttattttgtaaggaacatgtttgaaaaggggcattttaattatcctgtaaatgtttttacctcagcaataatgtttacatagctagtaatcatggctctcaggcatgatgagttttactgttgttaagttttgttttgtttttatacttaaagttctagggtacatgtgcacaacatgcaggtttgttacataggtatacatgtgccatgttggtttgctgcactcactaactcgtcatttacattaggtatttctcctaatgctgtccttcccccagccccccaacccccaacaggccctggtgtgtgatgttccctgccctgtgtccaagtgttctcattgttcaattcccacctatgagtgagaacatgcagtgtttggttttctgtccttgtgatagtttgctgagaaggatggtttctggcttcatccatattcctgcaaaggacatgaactcatccttttttgtggctgcacagtattccatggtttatatatgtcacattttcttaatccagtctatcattgatggacatttgggttggttccaagtctttgctattgtgaatagtgccgcagtaaacatacgtgtacatgtgtctttatagtagcatgatttacaatcctttgggtatatacccagtaatgggatcgctgggtcaaatgctatttctagttctagatccttgaggaatcaccacactgtcttccataatggttgaactaatttacactcccaccaacagtgtaaaagcattgctatttctccacatcctctccagcatatgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcctactttttgatgggttgtttttttcttgtaaatttgtttggttcattgtagattctggatattagccctttgtcagatgagtagattgcaaaaattttctcccattctgtaggttgcctcttcactctgatggtagtttcttttgccatgcagaagctctttagtttaattagatcccatttgtttattctggcttttgtttccattgcttttgatattactgcacagggactcatggagtcctgaagtccttgcccatgcctatgtcctgaatggtattgcctaggttttcttctagagtttttatggttttaggtctaacatttaaatctttaatctgtcttgagttaatttttgtataaggtataaggaagggatccagttttagctttctacatatggctagccagttttcccagcaccatttattaaatagggaatcctttctccatttcttgtttttgtcaggtttgtcaaagatcagatggttgtagatgtgtggtgttatttctgaggcctctgttcggttccattggtctatatctctgttttggtaccagtaccatgctgttttggttactgtaggcttgtagtatagtttgaagtcaggtagcgtgatgcctccagctttgttctttttgcttaggattgtcttggcaatgtgggctcttttttcgttccatatgaactttaaagtagttttttccaattctgtgaagaaagtcattggtagcttgatggggatggcattgaatctataaattaccttgggcagtatggccattttcacaatattgattcttcctatccatgagcatggaatgtttttccatttgtttgtgtcctctttcattttgttgagcagtggtttgtagttctccttgaagacgtccttcacgtcccttgtaagttggattcctaggtattttattctctttgtagcaattgtgaatgggagttcactcatgatttggctctttgtttgtctgttattggtgtataggaatgcttgtaatttttgcacgttgattttgtatcctgagactttgctgaagtagcttatcagcttaaggagattttgggctgagacgatggggttttctaaatatacaatcatgtcatctgcaaacagggacaatttgacttcctcttttcctaattaaatacctttatttgtttctcttgcctgattgccctggccagaacttcgaatactatgttgaataagcatggtgagagagggcatccttgtcttgtgccggttttcagagggaatgcttccagtttttgcccattcagtatgatattggctgtgggtttgtcataaatagctcttattattttgaggtacgtttcatcaatacctagtttattgagagtttttagcacaaaggactgttgaattttgtcaaaggcctttcctgcatctattgaggtaatcatgtggtttttgtcgttggttctgtgtatgtgatggattacgtttattgatttgcatatgttgaaccagccttgcatcccaggcatgaagctgacttgatcatggtggataagctttttgatgtgctgctggatttggtttgccagtattttattaaggattttcacattgaagttcatcagggatattgatctaaaattctctttgtttattgtgtctctgccaggctttggtatcacgatgatgctggccccataaaatgagttagggaagattccctctttttctgtcgattggaatcgtttcagaaggaatggtaccagctcctctttgtacctctggtagaattaggctgtgaatctgtctggtcctggactttttttggtgggtaggctattaattattgcctgaatttcagagcctgttattggtctagtcagagattcaacttcttcctggtttagtcttgggagggtgtatgtgtccaggaatttatccatttcttctagattttctagtttatttccatagaggtgtttatagtattctccgatggtagtttgtattcctgtgggattggtggtgataccccctttatcattttttattgtgtctatttgattcttttctcttttcttctttattagtcttgctagtggtctatcaattttgttgatcttttcagaaaaccagctcctggattcattgattttttgaaggatttcttgtgtctttatctccttcagttctgttttgatcttagttatttcttttttttttttttttcttgaggcagagttttgctcttgttgcccaggctggagtgcaatggcgtcatctcagctcatcacaacctctgcctcccgggttcaagcaattctcctgcctcagcctcccgagtagctgggattacaggcatgtgccaccacgtccggctaattttttgtatttttagtagaggtggggtttctccatgttggtcaggctgttctcaaactcctgacctcaggtgatctgcccacctcggcctcccaaagtgctgggattaaaggcttgagccaccacagccggccgatcttagttatttcttgccttctgctagcatttgaatttgttgcttcttgcttctctagttcttttaattgtgatgttagggtgtcgattttagatctttcctgctttctcttgtgggcatttagtgctataaatttccctctacacactgctttaagtgtgtcccagagattctggtatttgtgtctttgttctcattggtttcaaagaacatctttatttctgccttcatttcgttatgtacccagtagtcattcaggagcaggttgttcagtttccacacagttgtgcggttttgaatgagtttcttaatcctgagttctaatttgattgcactgtgttctgagagacagtttcttgtgatttctgttcttttacatttgctgaggagtgctttacttccaattatgtggtcacttttagaataagtgtgatgtggtgctgagaagaatgtatattctgttgatttggggtggagagttctgtagatgtctattaggtccacttggtgcagagctgagttgaagtcctggatatccttgttaaccttctgtctcgatctgtctaatattgacagtggggtgttaaagtctcccattattattgtgtgggagtctaagtctccttgtaggtctctaaagacttgctttatgaatctgggtgcatctgtattgggtgcatatatatttagaatagttagctcttcttgttgaagtgatccctttaccattatgtaatggccttctttgtctcttttgatctttgttggtttaaagtctgttttatcagagactaggattgcaacccctgttttctttgctttccatttgcttggtagatcttcctccatccctttattttgagcctgtgtgtgtctctgcacgtgagatgggtctcctgaatacagcacactgatgggtcttgactttttatccagtttgccagtctgtgtcttttaattggggcatttagcccatttacatttaaggctaatgttgttatgtgacaatttgatcctgtcattatgatgttagctggttattttgactgttaattgatccagtttattcatagcatcgatggtctttacaatttggcatgtttttgcagtggctggtaccggttgttcctttccatgtttagcgcttctttcaggagctcttgtaaggcaggcctggtggtgacaaaatctctcagcatttgcttgtctgtgaaggattttatttctccttcacttatgaagcttagtttggctggatatgaaattctgggttgaaaattcttttctttaagaaggttgaatattggcccccattctcttctggcttgtaaggtttctgtccagagatccactgttagtctgatggggttccctttgtgggtaacccgacctttctctctggctgcctttaacattttttccttcatttcagccttggtgaatctgacaattatgtgtcttggggttgcttttctcgaggagtatctttgtggtgttctctgtatttcctgaatttgaatgttggtctgccttgctaggttggggaagttctcctggataatatcctgaaaagtgttttccaacttgattccattctccctgttactttcaggtacaccagtcaaacgtagatttggtcttttcacatagtcccgtatttcttggaggctttgtttgtttctttttactttttttctctaaacttgtcttctcactttatttcattattttgatcttcaatcactgatatcttttctttcacttgattgaatcagctattgaagcttgtgcatgcgtcatgaagttcttgtgccatggttttcagctccatcaggtcatttaagttcttctatacattgtttattctagttagccattcgtctaaccttttttcaaggtttttagcttccttgcaatgggttagaacatgctcctttagctcggagaagtttgttattactgaccttctgaagcctgcttctgtcaactcgtcaaagtcattctccgtccagctttgttccattgctggcaaggagctgtgatcctttggaggagaaaacgtgctctggtttttagaattttcagcttttctgctctgctttctccccatctttgtggttttatctacctttggtctttgatgttggtgacctacagatggggttttcatgtggatgtcttttttgttgatgttgatgctattcctttctgtttgttagttttccttttaacagtcaggtccctcagctgcaggtctgttggagtttgctggcactccactccagaccgtgtttgcctaggtatcaccagcggaagctgcagaatagcaaacattgcagaacagcaagtattgctgcctgatgcgtcctctgaaagctttatcccagaggggcatccgcctgtatgaggtgtctatcagccccttctgggaggtgtctcccagttaggctacatgggggtcagggacccacttgaggaggcagtctgtccgttctcagagctcaaacgccatgctgggagaaccactgctctcttcagagctgttagacagggacttttaagtctgcagaagtttctgctgccttttgttcagctatgccctgcccacagaggtggagtctatagaggcagtaggccttgctgagctgtggtgggctccgcccagttcaagcttcccggctgctttgtttacctactcaagcctcagcaatggcggatgcccctccccctgtcaggctgcttcctcacaggttgatctcagactgctgcactagtagtgagcaaggctccgcaggtgtggtacccaccgagccaggcacgggagagaatctcctggtctgctggttgctaagactgtgggaaaagcacagtatttgggcggaagtgccctgtttttccaggtagtctgtcatggcttcccttgacgaggaaagggaaatcccctgaccccttgtgtttcctgggtgaggcaatgccccgccctgctttggctcgccctccatgggctgcacccactgtccaaccagtcccaatgagaggaaccaggtacctcagttggaaatgcagaaatcacccatcttctgcgtcgatcatgctgggagctgcactgcagaccagagctgttcctattcggccatcttggaacagaacttatttttattttttaccaccaatatctctgctgggtcatacagccttagcagccaggctgtttgcaccacagcctagacctgctgaagggtcctttcttgccttgagccccactcaaaactggcagctgccgtgtcatgcagtctgtagaccagagccatatcacaggtgtgttgcccccagaacccaacctaatcagcactgggcttcctcagcattgggggatgcaagatataacaaattgtcttttccttaggaggagatacccagcatgcctctgagcactgggtccctcagaacttcaccgcagttgccagaccctgaatcttcacagggcttatctgccaccctctggagcatgtgtgtcttaccaagggctcctgtgtgctggccaccctgtgcttagtctgtccagtcagcatgacggtgttgctctctttcctctcttaggcccagcactttcacagctaggttgttgctggaattcgtattttgttatcaacttagcatccagaaagaagagttgcatgtaatgcctgcagggggagggtacctgctgccctgtaggggagaggcctctgcagcatattccagctcagccaagtgcaagcccagagagtcccaattgagggacttgcaggtaggttgtttagactcaacaatatcataggcattcatctagaattccccatcccagttttcagaatgctgggttttctctcttagggcccagacctgcatacttcacttgccttggctgagatttaaacatttccagctcttactctcacaactggaccttggaaatgggaaacccacagcttttcattctgtctgcccatccaattcagatggtggcgaagactgctttgtacccactaggaaggccctgttgccctcacatttagctgttaactgcttgttaactgcagttcagtatcccgttatccttatgcagggcattagtacaattttagcactgactagccaactccgctgcttttctggaatttttccactgaatctgcattattgccttggacatgaaaggtatcccttcatttggacattttccaggtcaccgtcactgtaatctttagcaatcgagccatgacctgtgccagggactaccctcctatcaggatggcatcctcaactgcagagtggtctgtgagcatgtcccagatcccccatctcaccacctgctttctcagatcattctcagggcacttgggtttgtctgggtctgagcaacagacaccaaggtgggatcacagctataggatttgattaaggatatcacctatgtgaaagaaaagggggtagaaactggggaggctgagagagccatcaaaccacagtgcaaacctgacccttgcagtggggaggagagggggttgggtgttagcgagctttcctagtctgccatgaggtctaagggagattcagcagagccgatgaggggttcttgtctttaattcacctttgtcagcttttctcggttatttcatcctgatttcttgctgcagactagttttgtcattctccatttcatgtggtgggagttatccatttccatagttgaagacagcagccagaccaagctggatagcatagtcccacctccaaattcttagggaaggaccctggcccagtttcagccatgtctgggatctagttcacagttaggtgaaccaggttttatctctctaaactgagacatttcccagaaaagctggacaaactacagacctaacactaatactttatataacctctaatagtcctaaacattttattagcaatcattgttttattcttcacagacagactgactttgaagaatgatttggatgggtcatagttcttccaataaaggaatcaagaggcgtacttaagtattctgttggtgactaactggatcagttcattaaatgtttgtttttgtaattgcaaagtattttcaagggtaatcactgacccagcattttttcctttgactcttcctcgctcttcaatttattcaaaactgagttagtgttagagacgataaaagctgtctgggagaagaatacatttgttagagtacgctatggtttggatgcagtttgtctccatcaaaactgatactgaaatttgatcccccagatgttgggaggtatggcctagtgggatctcttatgaatagattagtgctttccctatgtggtaagttctcactcttgtgggaatggattacttcctgtgagggtgggtggttaaaaagagtctggcttccttggtttctgttgtttcttctctcaccatgtgatctctttgcatacacccactgtcctcctattttccaccatgagtggaagcagcctgaggcccttaccaggtgcaggtgcccagaatcataagccaaataaacctcttctctttataaactacccagtctcaggtactctgtatagcaccactaaactaagacaagtaattgacactgaatttgaaaaccataaaaatcattactacattattagaactttaaagaagagctgcaaagccgtcttttctgaagttgtagacaggtagcatggcctctctctcttgtcttttgtatttatacaggcataggagttccaaatagaggtttaatgaacatgagaaatgaaggctggggattaattagtcaaagctgaaatactgcaacaacaatatatgaagtaccccaagggaaggccaaagagaaatatatatgtaaatgtctatggctgtacaatcagcaaacattttttgaataatcaggttgtgtcgagggctgttcagggcattgtggggaacacagaattcatggactcagtcccaaattcaggcagctcatagttcatctgggaagaagacaactgtgagtcctgcctctgccaggcacagagacccctacagtttgcttgggatggttaatggggaaatgaatgaagtgccgacatgttgtcccttccaaatccctctcagagctccctgttgctctaaaatagagtgtatttatagaaaatgtgaggtatagtgaggtcaacagattaggagacaattgccatagaaaagatagcttgttacagttcccaagaggagggggtcacagcacaccacgcagggccacataggaagcacagggtccttgaggaggcagagcgggacggggagctgtgggccggagtcttttttgtggtttctgtgggaaggagtggacaaaggggaagcagagtcaggattggcgggtttgaataatttcagtgggctctcagcttgggggctgtttctacttgtctagtagtttggccatggggtgatgtgcaggtgggtagtggctaggagtgtgagagccacatcgaggaggtgataggtgtgataggtgtgtgggctctggattggttggtttgcattttgaagagggccctcttgggtgagctgttttccatctattggaattagtaaccttgggaggatggcaccaagctgtccacccccatgatccaaaagtttcccactgggccccactttcaatacctgagatcacatttcaacatgagatttggagagaacaaacatccaaactatatccctaatcttgtcaaaatgaaaatatattccagtcattggattttctagtattgtatgaagatgaggctggttgtatgattaggaggtttgaaactctataaactccttaagtaggaagttaagattttatttatcatctctttttttttctttttttttttttaagacagtctcactctgtcacccaggctggagtgcagtgccacgattttggctcactgcaatctctgcctcctgggttcaagggattctcctgcctcctcctcctgagtagctgggattacaggcatgtgccaccacgcctggctaaatttttttttgtattttttgtcgagatggggtttcaccatgttagtcaggctggtttcgaactcctgacctcaagtgatccacccaccttggccttccaaagtgctgggattataggcttgagccactgagcccagcatatcatctcctttttgaggagaggggtgaaagggatgcctaggatgttggagaaggcttttctgaagtgtttggtgatccttgactcttatttaagtctgaggcactaaaagctggtgcactctgggtgcttggggagattttgacaggtgttactgcctgggtggcagtttcagcaggggaaagcctccctccccagtgttcatatttgtagatcttttctcttcaaacattccccaggaaggaatgctccagtgtttttggatgggagtaaaagccaggctgcctgtgttctaggagccaagtggaacaagaggttggggagctgtctcaccagtcattgtagactttgatttagtattcctgtttccagtacatttcctcccctacctttagctatgcctagagtcccaagttcaaattctttaatttacctttcttttccagagagtaaaacatcctgggttgggtggaggaagacagcccaggaagggagaaggcattcttaaaaggagttttaaaagccaccccacctgttttatctcccctcaattcccgtttcgcacttacctggtgcctcctactcctgagccttttgtagggagggagaaggttctgtggctcaggtgggcttacttgcttgggttggtaaatggggacattgacctgctgcccccagttagcagcctaggtgtaccaaaatgccagaggtttgtctaggtccagttgcgtgccacacagaaagccaatcactgagacaatgagtgttgctagggaagaaagctttgattgggtgctatagctcaggagatggagataagcctcaaatccatcctcctgacctactaaaattaggggtttatgtagcaggaagaaaggtaactatatgtgagaaaacaggaattagggagagataaggaagaggagttggtcaacagggaacaggtggtcttaagcagtcatgatgggtgaggagtctgacttctcatggtccagatgagatgatctagtaagttttagttttttaatactacctggaaggccggatggatggttgcctgagaaagcaattcagataagacaaatgtaacttgctcaggcttcaagactcggagggtcaatttctacgtttattcaaagaaaccataaacaccagttctgtgggacaactggggtgatgtcataatggtggcctttcctgtctcttaatctggttaagtggtcttcaggtttgtggcttgtgtctcctctcttgctcttgatacatgtggactttttgcctttcctctctctcctcatttcagtgaagagagaagtcagaaatatggaatatattatttttctatgaagtgagattatactatacatgtaccttcaggctctataaaactcactaaagtaattcactgtttgttgcattttagctgattctgtcacatagaaattttaggataatgaaaattcctggaaaatagtcaattttcaagggaattaaaattccagatttgttaaaatgtgaatatgagcttataaagaatgtgttttcaattttcagattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagtaagccatcttttttctgattaccaatgacattaactttttgttagcaaattgattttaatagttaaatgattgtccaaagaagagattgcagctttaaggaaaagatcctttctccttctgtatttcccagtatgaaattgaccactgcacctgtactgggcttgtgatgcttaactttaggcaatgaagatgtgatgctcttaccaactcacaaattattagatgagatcaaatgtacagatttaaaatagtgttaatttttaaaagcttttgaaaatgaagataattggtaattttttaaactatcaattattatgaattattttgttaaacttgaataggaccaattgttttgttttttaagtgtaatagattgaaaactagttaacacctgtaatatgcctggcacatagtacctacttaataaatatctgttgattgaataacatcccaaatgaaccatagtataaagccaaacaatagatttgctgattttaacctactaaaagttaaaatgcagatactgatttctgcattgaggtgaacagatcagctggttattttatgtatatggtaccacgtatatattggcatgcatagatgtatggcaaatgcaagctaggaagaaaaggctgcttcttattctcattttgaatattaatattaaatatctgaagaatattttataagactcaaatatgcatgaaaatgctttttccttcaaagctttttgaagttgcactattttcccccaaacttttacatttattttctgatcttgttttctcacttcatcctgctccttttcagtttaggtggtttatgtggcatttttggtgacaggttttcacagttaaatttttcagaaactctgttaataactagaaaatcttccatgaaatgtcccatattggtagcctcaagcgaagggcaaatttttttttaactcaactacttttatttatcttgaagaaacgctgcaggtaagtattggtttctttaatagagttgtactgtattgttacggatatatttttaataatatctataatcattagctaaggcaaaagtatgtaaagaaattacataaaatgttttttaaaataaaattttcctggaatctaagctcttatgattgacttttggtagtggtaattgataaaaatatacaaattcacataattacatgaagactgcttgtaaattattgaagggtaaaattgtttttgcgtgtatttatttttgtaggaatgcttttagtctcttgtttttatggctgaaatgcctgttggcacaaagtgtaagtgatgaaagccgacataaactgtcagagttttaataatcaatctgtatctcatgctgtaataatcggcggagtgttgtgttagttgtgtttatggtgtttgcttggccacagtctcctgtaagtgaatctgcccacacagtatgccttgttctacatggcccttgtggtaaatagaatagtaatagcccctccggatatgtccatgtccttatccttggaacctgtggatgtgttatgttacgtgtaagagggaattaggattgctagtcagcttactttaagagaaggagattaccctggtttatctggtttggttcagtgtaatccacaagggttctttaaatgggaaaggagggaggtagaagaatcagtgccagggtgacgtgatgtgggaaggacccaactgccattgctggctttgaagatggaagaagaggggccatgagccaaggaatgcaggcagactggagaagctggagaaggcaaggaaattggttctctcctgaagtccccagaaagaacacagatctgcccgtacattagttttagcccagtgaaattcgtttctgacttctgacatccagaactgtaggatagtaattggtgttattttaagctgttatgtttgtggtaatttgatacaacagcaataggaaaccactctagctttggttgtgttttgtaccacccaatccactgtagcctcatgattgggccggggctgggaacctgcctagtggatagtcagttctgagttacgctactgcagtgcatctcaacctggcttctctatcagagtcacttggtgagctttaaaacaggatgctaggaatcacccgagagattgtgcttccggtaagcaccagagatgacccacaaaattagacacccatgtgtctggatggaaaagatgagctgggtgagtcagatcctttcaggaagttcgaactaagaaatgcagtgaatttgctagtctcttatgagacctactgctaaaatgtcatctgggggtgaaaaagccgtaatgaccaccggttaggcagagttgtggagggggctgaacccgggaggaagcagaaggaagccagttgatgaggaaaggcaaaagaaggatgtacaaagagaagcaagaacatgagcgagaccgcaaggcccacaaggtggaggcagcagctgcttcttgacctgcccaggatggctttcccctcccatttgtggtgcagggcttgggtgtcctcacagtgacccttcctcacttcaggttcgttgagtgcatctggggcttacaacccaaagagcattacagaaagagaagcacagtgatatatactgccaaggatataattttggaaaacgaagataactgagtgcaatgaactgaatgtttgtgtctcccaacaattccgcgttgaaatcctaatcctcattgtaatggtctttagagctaggattttggggaagtaagaggtcatgaggtggagtcctcatcaataagattagtgcccttattaaaaaggcctgagagagacaccttgccccttctgcctagtgatgccaaagcaatgaggcactgtcttgaagaagagagagcaaccctcactagacaccaaatctgctggcaccttgactttggaattcccagcctccagaactgtgagaaataaatttctattgtttataagccacctactctgtggtcttctgtcatagtagctcaaattgcctgtgacactgaattactgattggtgatagaatatcaaagtagattatctgtagtttattagtgtttattcattcattcttctttgtatttcatagaattatatctcgtatcaggtacatgattgtgattatcagcagcctaaagtagtagtcttccttaaaagatgccgttttatgggagtagacattctctgttttaatctactattcttttacacacgttgtctggcaaaataaataaaaatataaatataaatgtgagacaggtggaaaaggaaaaatatgtgacctgtaatcaagagaaacagaagtcagtcagtagaagcaagacccacagatgaccccaattttggaaataactgatgagtactttagaatagttatgaaaaatttattgaggggtcatccagtttctggtctggcttttaaagagtttggaagtcactcctgtctacacaataagaggaagttcaataatctgaaaaccagccttttgaaagatccatgtaagaactgaagttacaggacaaactgatgcccccaaatttggaaagtaagtacaggggacagcaaataactttgaattgggttctgcttagaagttaaccacatttataattttaaaaataattgataagtcacatcaacatgattataaagtaggaaacagatatgcagttattacaacctgctacaagacaacactagcacatagtaaatgatgtcaatgttttgcatgaatcttcagttgttcgtggtttgccactggatattaatatattacaggggatgaggaaagttatatgcaaatatatatgagctaaagttgttaggaagaataagagaatgtaaaggaatgtttttatgttatttttaaattttgtaatcattcatcaggtatttaaaaattttaggaatgtatgagcctatagtattaaaagtcttcttttacagagtgttcattcctgtgacaaagtcaaaacataatctgtttttaaattcctttgggtacttacccggccattattcagtgggtccaaatgagaatggatcatcttaatcctccccacttcactgctcaccccccacacctgtgtcactcccctcccacccttacctccactccccacagcagaaaatcattttcaggtacagattgggatagatgatgtttaattatctgcttcctgtaagtgatacagagggggactagactttctctacatatgtatcttaggggaaacaccagtgcaacttagggatttgccttgagcctgccctggtcatccctgcttgagcagcaggaacttgccctgggagacctactgtgaaaacccagggcaactaattgttctagggaaggaaaaacagaccaggactccacagggagtttctttggtcttttctaaataggaagagagttacctgatcattctgattcttgtcacacttatggagacagttcagggtcatgaggatttaaatgactttgcataaagcaagaaaagaatctggtcttagatagcaaatggaattctgaaggccctacaactttacataacttttaggaaatctgtaggtttttagctctggatatgctcttactacatccaaatcagacacttcacttcaagggccagaaattttgtcaccgttaaatttttaacaggctttttagggaattgaaatctttccagtgagactatattgaatttggtaacagtcatagaaatgaaagagaggaaatttgtaacatgaatgacgatatagtttaaaaagatcaccacattcaaaggtttgtccaataattttttttaagtctgttttaattttcagatttttttctttgagtgttacttctgatacagtacagtgtgagcaatcagagtggctgggggaggatagccgcttggcaaacagttttaggtgtgttacttggttttccagctagggaattttgatttttttttcttcaaataatgacagtttagtgttaattaacattaaaccgggagtgctttttcatcattttccttgattaataatctgaatgctcttgttcctgtcagctagttgatcaattaaaatcacagtatcttgtaatcagattcctactggtattatgatgtagtttcaatataatttgcttaaaaaggagatgacatttgtgccaaggatgacaaaacttctttttaatacctcatatgtatggttttgctactttttttttctttgttcttgtgataatagctgtttttcgctcctcccccataaaattcttctcaggatgtcacaaagaaaggagttagaaatttagtgagccctgccgaaaaaaaaaaatttggcgacattaatggtactattaagataatatagaaaatttagcatagaaacacacaaaagagtcaactttacaaaattccgttaatcagaaaaaattgtaatactttgaacatatttttatacagatggtatttcattgtacatatggttttatagcccatactcactgtacagtaaacatctgtattcttataagacacatttttgaatagctggagattattatattgatacaccataattatttaaccattttactaatgttggacatatagttatttgtgggggaacgctattataaattcttactcaaaataattacatacatctctggttgtttttgatttttttaaaaaagatttcttatgtcttaggagtcatcaggcttcttcataatgagcagggatagtcgtcataaatggcccaaaatcctgtgactccattaattttaaatatgcttctctctttgcaaatcattataaaatctatttaattttcatgtgtggagtaattgtacaaatgagaaaggaagtctgttttcttttcaaaggtttttaagtgattgtttttattaatactccttaagacacacattgtgtttcccagtcaaccaaatgcactctaattcagttgctttatataattggatctgaaatttggaggtgtgttaattgacataagtgcagttctactcaggataaagatttaagaattttaaaggcatgcgctgaataactttcttggatgtttttagccaaacaagattttttggggaggtgaggaagatagaacacagtttatgaaggaactagattataagtaaatttctgtacagtttgaggctagggttgtgggtaagttaagataaaatatattgaggtgtccgaccgaagttgactgggaggaacacagcaagaatttaagaatttttaatgctgcaaacttatttttgcatctctcatgaacaaagaaagccagtgcaggtaggtaaaaagtaatgtatacttaggaaactagaagatagaagttctgtcagcaggagaattgatggcaagtataagagccccaccaccccgacaaaaggcaggattataggggattcacactctcattacccattgacccggaatgtcagaaatactttcttaagggtattgtagaagtaattattagttaggttttttatttctccttcctccatatggattttaatatagcaagatttaatgcatcataattcttaggagcacaagttagagagtcagccaaatctgaattttcagttctggctatcactaaatttatctggttttatcatctctcttctttgtatttcatataattttatctcatatcaggtacatgattgtgattatcagcagcctaaagtagtagtcttccttaaaagatgccgttttatgggagtaaacattctctgttttaatctactattcttttacgtacgttgtctggcaaaataaaaatataaatatgagataggtggaaaaggaaaaatatgtgacctgtgatcaagagaaacagaagacagtcagtagaagcaagacccacagatgaccccaattttggaaatggctgataagtactttcgagtagttatgaaaaatttattgaaggggcatccagtttctgatctggcttttaaagagcttggaagtcactcctgtctacacaataagaggaagctcaataatctgaaaaccagccttttgaaagatccatcaaagaactgaagttacaggacaaactgatgcccccaaatttggaacagaaagccttgtgggaaccgtttcagggttgcagaaacttggtgagttgctggaggctcattgaggacaagtttgagagttaaaagctccagaagggcccagtcagaggggcttccacacttgtgtgtttttctgccagcaaccttaccaggttcttacattgaagattggagaaaaatctctttgttcgtccattcaggagaggggaatggactttaaaacaagcccaaaacatctgggcacggtggctcacacctgtaatcccggcactttgggaggctgaatcatgaggtcaggagttcaagaccagcctggccaaggtggtgaaaccccgtctctctaaaaaaatacaaaaattagccaggcgtggtggtgggcacctataatcccagctactcggggggagaggcagagaattgcttgaacccagcaggcggaggttgcagtgagcagagatcacaccactgcattccagcctgggcaacagagtaaaactgtctcagaaaaaaagcgcccaaaacatttgactctttttaacatgcctgccctcaaaagaaattatttcaacagagcctaacagactgagattttaccagagcttaacagacctggttggagggaaatacccaactccagtcccttctggtcgtcctgcctaacctgaggggaagcgggagtgagacccagggccccaggctcactagaagactgagaccccagtcataggactgtataacactcccttttcactgcccctcacccgacaccctaccagcacagcattaaaggcctgtgtagtgggattcctttcaccttgtttgtcatgtctggttttcatcagaaaattacaaagcatactaaaaggcaaaaaacacagtttgaaggtacagagctagcatcagaacaagattcagatatgggaggagtgttggaattgtcagaccaggaatttaaaagaactatgattaatatgctgagggatctaatggaaaagtagataacatgcagggactgataggtaatgtcagaaagatggaaattctaagaatcaagaaaaatatattgaatgtactgcaaaagatgaacaacgtgtgaggaaatagcagtttcagcagagaaatggaaatcatttttttaaatgccagaactgaaaaatacagtatcagaaagaaagaattcatctgatggacctaatagcagacaggacccagcagaagtgattggtgaacttggaaataagttaatagaaattatttaaagtgattcacaagagaaaatgaatttagaaagcaacaacaaaattttagagcattcaaaatatgggaccatatcaaatcgtctgacacatacgtaattggaatctcagaacaaaaggagaaaaagagaaggaatagagcagaagtagtaatggaagataagttttgaatattgatgatagatatcaactaacagacacaagaaactcagcaaattcctgaaagtataaagaaaaccacgtcataataaaattgctaaggaggccaaggcaggtggattacttgaggccaggagttcgagagcagcctcgccaacatgatgaaaccccaactctactaaaaatacaaaaattaggctggtacagtggtgcatgcctgtagtctcagctacttgggaggctgaggcatgagaatggcttgatcctggtggcagaagttatagtgagctgaaattgcaccactgcactccatcataggcaacagagcaagactctaaaaaaacacaaaaaacaaaaaccaaaaaccaaaaattttgctaaaggaacagagatgaagagaaaatcttaaaagaagaaagaggaaaaatatacatcatgtaaaagaagggaacaatgttaaggatgacagctgacttgtcatcagaaacattggaccagaaaacagtgggtaagtgctaaaaggaagaaacttgtcattctataattctatagtcagtgaaaatatcttttaaaaatgaaagacattttgttcagacaaaagtctcagagaattagtcctccagcaacctgtactacaaaaaattcttaacgcttcagggaaatgataccatttggaaacctggatctgcaaggagtccagacaaagtaaatatgggattaaatagaaaaggtcatcaataattaggtctgtatctgcttaaaagactagtaactgtttaaaatttatggcatttataatgtatgtgacagtaaaatatgtgacagtaaatgctgagtgtgaaagtgataaatagacttacactgttgtgttttacattgtttatgaagtactatgttatttgaaagtagagatgagttaagggtacatagtataatttctagtaaccatcaagaataacatagatatcaaatgaaatcctaaaataatgatttgattatcccagaaggcaagaaaggaagaacaaaggaagaaggaacagaagggccaaatggaaaacagtcagatgatagattgaatcctaaccacatcaataatttctttaaatagaaacattttaaacttcctcttaaaaggcagagattatcaggttaaattaaaaagtgagactaaaatacatgcattttgaggatgaagacactgatttaaggaaagttaatgaaaaaatatgccctgcaaacacaagttataagaaagctggtgtggttttgtgaatgtcagataaaatagaatataaaacagataagccaggacctttaatggtgataaaagagtcaagaacacagagctttaaatgtatatgtacctaacaagaggactgcaaactacatggaataaaaatagaactgaggggagaagtaggcaaactcaaaatcatagttggagattttaacaagtaccgctcagtaattgaaagaacaagtggacagaaaatgtgtaaggatatagggggtttgaacaatataccagccagtctgacttaattcatctttgtataccaaactcccaagttgtagaatacacattcttttaatttcccgtgaaacatacaccaaaacgggacatctggtaggccataaaatagtaagttttaaaagattaatatacagagagtgatgataatgagataattataatctttttagataatgctcaaatattggaaaatcaaacagtatttaaaaaataatccttgggtcaaagaaaaactcaaaagggaagttagaaactattgctaaccatgtggtagtgaacacaaaatgccattgtatttgtgggattttgttaaagaagtgtatagagaaaaatttgtagctttaaatgttatgttagaaaagaagaaaggtttaaaatcatgagcccatgccttaggtagggcccttggtgttgctcagcattcccgttgtaatctctgtgttaattaatttttgtgctcttagttgcctatttcatatctttccacctcgcacctccccactctgctgatgactgtgcttcttatttcactggtaaaagaaaagcaatcagagcagaagtaaaggtctccctctgacacattgcacgctgataggctctgcatccacgtgtcctgttcaccctcccttaaatggatgggctgttcatgctcctatccatgctgtctcctccaacggagcactggatcccatatcctcagggtgcttccaggatacatgtaccttctttcttctctgtattatttttccccctctttctgtgtcattctcatcaagtataaatatgcaaagaagtctcccaatttgagtaaatttcagatcatcctctccctgtcatcccatttcttgctcccacagcaagattccttgaaggatgtattcatatctccatggcctctatttcccacattgtttgttgtccccattgagatttcatcacactcaacgcttttgaaactgtgcttattggcatgaccagtgactcgcatgctgctaaaatccagtggccaggatcagccttcttacttcatctgttactggcatgcgactcacagataactgtctcctctggagaaactctcttcacctgcacagtggtccgccacctcactctggtgtttttcctacctcccaagctgtgctttgtctcctcagtgatcttccccacttggctcttctctgcctgttctcatttactaagtgacctcatcaggttccatggctcaaagtaacatctttatgctgatgatgttcaaatgtgtgtcttcagttctgacctatctcctagtttcaaacttatatacaactgtacaactgtccactcggtgtcttcacttggatttctaataggtatctctaatcccacatgtctaaaatttcacttatgatttctttctctctttgccagccatcccctatctgtcttagcaagtggaagctctcctcttacagtgcttttgattgtcttctttctctcctatcagagacatccagtccaatagtgaaatgacgtcagtcatcttcaaaatgtgtagcaagtctgtatgcctgttagctgccctgatgtcactattccgatccaagtcactatgcctcttgccttctgttggatttccagtcactccccaccgacccccgccccaacacaaagggaagggcatctatttctctgtcctcttcttctacccttttccccatcactcactagcctttagccacactggcttccttgatgttgctgacatacaccaagcacatatttgtcttcagcctggaaggttctttccctagatattcatcttccccctcttcagtcacttgataccatcctatcagagagggcttttgtgaccactgaaataccaccacccacttccttccactctgttctctataaaaaatattgctttattttccccatagcacttattttcaccagacatattgcttgtttattgtctgttttcctcaaccataatacacccttcatgagaacaggggctgtgtccacaagtatatttcttcaagcaacaaggacaaggcctgatacacagtcgatgcttgaatatttgctgaaaaaatgaatatgcttaataatcaatgtctgttatctaagttcttaaaatgcttagaatattgtaaagaagtattttaaaagttcattatagttaattatggttgacttttctttctgtttttcttaatttttcaaattttctatcatgagcatgtgttagttttataatcaggacggtagcagtagagtctttaattggactttgggccatttttcctaccgtttactttcctgtattttctgtatttcttacaataagcatgtgttgcttttataggagaaaaaataggtttaaaaaagaggaaaaaactttaagcccaatattatgacttgttattttatggaattcaataggaactgacattacagatactataataaagtttcttttttaacttttcattttgaaatgattttagactttaaaaagaccaaaaacagtacaaagaatttccataaactttcacccagatttcccagattttgttttacatttcttctttttctcagacttctcttccactttcccaccatacaaatgcatgtatgcatatatattaaaaatgatctcttttttgtctcctttaatctgaaatagttcctcagtctttctgtgacttttatgaccttgacacttttatgaccttgacacttttatgaccttgacactttagaagggaaacagcatttatgttatggaatgtccgttggtctggattttctaatgtttcctcgtgactggatttaagatattgaaagaaatatcacacggtgatgatgtgttctcccctgtgcgtttcattaggaagctcatgtgtctgcttgtgtcataactggtggtattgactttcatcagtggattgattaccccaagtttctgtaatgcaaagatttttttccctatgtgattaaaaagtgtcatatggggagacactttgagactatataaatgttctgtttcccatccttctatgaacccactagtctcagcatccattgatgatccttgacagaaacagttgctgtggtggttgcagaatggtgatttttttgtcatgccataatttcttcaacattagttagtaagcattctgctgcaaatgctttcatttatttccctatttatttacttgctcatttatatcagtatggactgatggattattttattctgtggtttataatccattgacttattttgatccttacgtttttccacatttggctggtgggagccctttcagacaggcttctgtgtccttttgacatctccccaccaatctcggaagtaaagtcctttgagtaccttactctttctagcacagcaatacattctaggttcatgtggttttctgccctcagccctggagtcatttttccaagaagcttgattccttttagtggagtacaaaaagccaaaatcttgtcaaaccaagatctaggttccagtgtgtgtgctaaaatttatgaaagccctagttatgactgctcttttgttccccagaaaggactcatacaagataccttgattgtttccagtaaatctttacttttaaatacagctgaaaatccacgtacagtttttatgctttggcaatttagaggtgtgagacaaagtcaaaacattagtgattttctttatactttgttttccaaagtaaaaaaaagtttcttttaagctattcgtgtcttaaaacaactgagtaaagtgtagtttcataaacaaatgaaaacatttacctttctctttacctaaactctctttacttaaaactctctttacctaaattctctttacctgaaactctccagaatttagaaactatttatcagtggctaaggccaaaataattgtcactcagttactaaaaataattcattattcaaaaaataacatataatttcatgtcgtgactgaccccatattactaacaatctggccagcctacaataaataacaaaattgtttttcccccaccaagaaacatgacttcctggtaataaaccttcccaatactaagaaataaaaaaaagtcttatcattctaacccaaacaaaaattcatcgtcaatacttccattaaagtttttaatttaaaagtacagttaatatacaaatatatcccaattttgttagttatgttttctccgatctgtaactcactttcatggtatttaaaattatttattttaaataaatactaccatatataatctatagttccttgtaatagtcccattaaaatagattaggtacagaaaaagactacatcaagaaaaaaacgagatcatactaattaaagaaataaatacagtccaaaacatgttttctaataaatagacaagtatacaccccaaacctgatactcattccttatgactatgacaactgtgactaaagactatggactttcctagagaagagccttcccaactacataatacaatcactgctggtcttgtatatacaacagagggttgaattacgaccagaagggggaacttgtgagacaaagtaacaaaagtaagaagccctttgcttgttcgcttggcttgccagcagaatttcaacaaaatcccttgtcaacaaaacttcacaaagtgcctgactcaaggactgagagcagccctctggaagaatgccctaaagatgatacacggggtagagcgcaggttctaaatcactgcattttccaaatacagaagataatgtctaaggattttgcttttatcatctgtaaccagatgtatcctcacattttactctattgtaacttgtattaggttggtgcaaaagtatctaatgttacttctaaacacatttgatgtacctgctagacacaggcagggccgccatcacttatatataaactgtgggccaaaatactactttaaaatagtataacaactcttgagaagcctctcccgggttacattcctcagtaagacttacaaataaagctaactttaattcttcaaaagcctgatttttctttagttaacagaggcatttatctcaacctgatgtatttggacatgagttcatgtggtactaataagtccagaagtggaacctttgtcaacaaagaatgaataaattgcatttacctcaatgtgctccataattcagaattagtttagctattaatggacttgctattgaaagagtgagtagaattcagcttttcaaatcatttgctgtttgcaaaactgaagattgtaattataacactattcttattcatcagaaaatatagctctttccatttttttctcttcagacacttgtcagctttcagcagctggcaaaatattaattatgcaagtctctaaattttatgtccctttataaattgagaacttctgagtggaaatgtagtatcagttgcatgtttttcaaatagggttaggcatcggacctagaagcaaatgttgcttgtccttttctgcttatgcagcatcgagctgagagtacatgatgttgttctcaacaatagttggtgtgctttgagagtattgctgtcacttttgcaagaggctattgtgtatacactcccatagtcttggtgtatatgctgtccctattaattagttttctgtacagccgaaggggatgggatgggagcttttaaagttggactggagtatgtgtgtatatataaatttattttaaactatgaatggtcaagcagaaacacaataattggtttcattttgtgactatgtcagacattcagaaataaagaactgatagacttgaatatgaagcatttggaacgtggtgctcatctacaaaacacccagcatttcaccaaatggattctataaaacagtagttctgaaagatgttattaggcgtttccaggcccagtcactatgagaacatgatatgttagatgcttctcttgcagattgccagtgcacattagcttattaatgactttaagacaccccaaggcatagaaacatgtttaatccttctagctcctcattgcccagcctgccttgagcaggaagcatttgttggctttgtgcttgttaacaagaaacactggcatagatcatgtgtttttcattcagctgatagttgttgagcactggctgagcacaagcagtgcagaggtgaaaggcagaactccaactctcctagagcttagatgaatgaaggcaagattagagttccctgacgagtcctgtgatccaggtcagcttagggcattgtggagcacagagggggtcaaatgctcttacagagcccagtctacatcctgagttagccaggactcagttcttatgtttttgttcacttattccgaaatcttttctgagtacctactataagccaggcatgctctagacattggagactgatatagcagtacacagagctaaggggaatccttgtctttgtggatcatatgttctagtggtgggagacagatgagaaacaagatgaatacatacaagtgcataatttattacttggtgattagtgctagtcaggaaaatacagcagagcagggataagaggggtgtgtgatcacatgtgtgatgaggtgatggcatttagccagggctgctaggaaagcctcacttagaaggtgacatttgggtgtagagctagaggaagtgagggagcaaaccatgtgagtttctggagcagaagtggtctacgcagaaggaactggaaatgcaaaggcctggggagaagggggatgcttgggtatgtctgagaaacagtgaggaagccagggtagttggagtgggacatacaagcgagaggttaataggagatgaggcccaaaggtgaacggagctaggtcgtgtaggagcttataagtggtcatctggcctttagcttttattctgagtgaattggcaaggcatggaatggatttgaacactcagaggagtaacaggatctgagactggtttggacaagatgactggggctgctcggttgagagtgaactgagcaggggcgtggatggaggcaaggttgctggaagaccaatcccttggcggttagggaggtcgaggtgagtggtgattatgccttgggacagggtaggatcagggcaggtggtgcgtgcagagcagtcagaccctggatatattctgaaaatggatgtgtatgacagtttgctggagagccagtgtggagtgtgagtgattgagagatggcaaggatgaccctaaagtctgtgactggagcaacgggaagaatggagctggctcttccaagaggggaagatgggagagaagcaggcttatgagggggtattaggactccattcagggcaagttatgtttcagttattagacacccagtgatgctgtcagtaaggagtttgatacatgcatcaggatctcaggaagaggcccatctggaggtagaaatttaggaatcatcagcatagaggaagtgtttacagccattagaccggatgagatgcctaaatgaatgttgatggaaaagagaagaggttggaatatttaacacagatctttttttctgtgtcagtagcttttaaaagtggagtttttggaaatattaaaacactaggtttagaagcagaagtaattagcttttgttttttgtttggtttttttttttttttttttttttttttttttttttagcaaaaagaacttttgttaaataaaaagaaaaagccaagacctcgagccctggactcctgtggaattttgagtctggggagggaggaagcagcagagggagcagagggcccacgaggcaggagggcacctgcaggctcttggcaggcaggcttggcctgggcatcatggtcagcactgggccatgccagagagaggccggatggatgaggcctgagaactggcccttgacttagcagggagaaatggtctgctgagttgggtcagccctttcatagagtgatagggcaaaaacaggactggcgtggggttgggcagaatggggaaaggggcgaggacagagcagcatggggtactctggggaagctttgctgcgaagggaggagagtaagagtgtagggtgaggagcaggggaagagggagggtttttcagtgcagaattctagatttttatgattttcttctccaggtttttaaaaaaaactgtgataaaatttacataacattaaatttaccttaacagtttttaagtggacagtccagtagcgtctttgtgtgttgctgtaaaggctgggtaacttagaaagaaaagaagtttatttagctgatgattgtgcaggctgtacaagaagcatagcacgagcatctgcttctggtgaggcctcagaaagtttccgctcatgaaggaaggtgaaggggagctgtgtgtgcagaggtcacatggagagagagaggaaacaaggagtgggaggtgccgccaggctctttttaacagccagctctcacaggaactactagagcaaaaactcgctcacccagggagggcattagtctattcacgagggatccacccttgtgatccaaacaaattctatcatgtcccacctccaacattggggatcacatttcaacatgagatttggaggcaaccagcatccacgctgtagcaagtaatgttaaccactgtgtacacatggctgtgcagcagatctccagaatgttgtcatcctgcagaagcaaaactctgcgctcgttacagaactccccatttccctcttcctctgacccctggcaaccaccattctcctgtctctatgaaatggactactttacatgcctcatataagtggaatcgtacagtatttgtcttttgtgactgattaattttgcttagcctaatgtcatcctcaaggttcatccatgttgtagcatgtgtcagaatttccttcctttaaaggctgaataatactccattgtatgtgtgtaccacattttgtttatccgttcatgtattgctggacactcaggttcttccacctctgctactgtgaatagtgcttctgtgaacataggtatgcaaatgtctcttcacatccttgcttgcacttctttacgggtatatactcaagtagagttgctgggtcatatgtttaattttggggggaaccaccacacagttttccacagcagttgtaccattgtacattctcaccaacagcgcacagggttccaatttctccacattcttaccaacacttttctgcgtttttgtttttgttttttaaatagtagcatcctaatgggtatgagaggtggtggtgagagggatttcagtcattcttaaaactgttaaaatgattgaaatcatggcagatttgtaagaggagaaatggtaggtaaagcacttgggctttggtctgcccctgtgagtgctcaggagtgtcagtcagctactactgtgaggaagggggtgcccatgcctgaggcagagggagcagagcagctgtgcagaagcacagagtgtgaggaagtgggagagtgtggggctgcaagtagtgcattctggctggagcaccaggcaagggcagaaatgaggtgcggccagttagaaaggctactattaaaaagtcaaaaaataacagatgttggcaatgctgcagagaaaagggaatgcttacttactgtaaacatggtgggaatgtaaattagttcagccactgtggaaaggagtttggagatttctcaaagaacttaaaacagaactaccattccgtccagcaattccattactgggcatagacccaaaggaaaatggatcattttaccaaaaagacacatgcacttgtatgttcatcacagtgctgtttgcagtaagaaagacatggaatccacctgagtacctatcagtggtggattggataaagaaaatgtggtacatcatgggatactacgcagccataatgaagaatgaagtcatgtcttttgcagcaacatggatgcagctggaggccattattgtaagagaattaacacaggaacagaaaaccaaatactgcctgttctcacttttaagtgggagctaagcactgggtacgcatagacataaaaatgggaacagtagacactggggactactggatggggagagaggaagaggggcaaaggccaacaaagtgtctcttggatactgtgttcactacctgggtatgggatcattcattccccaaactgcagtcactcaatatacccatgtaacgaacctgcacatgtaccctctgaatctaagataaaagttgaaattattttttaaaaaaccggggaaaaaagaaatgaagtgcagtgcacagggccctctgtgtcatacacatacacatacacatacacatacacatacttattagattttatcttgaaatgacgaggagcagtaaagaatttaaatagaaatgacgtagtcagttctttctgttagatcatttggcagcagtgtgatgcatgggttcgggggtgggaggtgaatctaaaagctattgatgtaattcaggagagaaacgagggtctggggcaagatggcggtgggtgtagaagggacaagacttggtgttgagttagccgtagagagagggagctgtcacaatgacaccatttctggcttgggcttcattttggatggtgggttctttttaacatggggatgcaggtttgaggtaaggtgaaaaggagttatatttcagcttgtacaggatttgagaatcttaacagacgtcaacatggagatgttcagtagctagttagataacaagtctggagctcaggaaggtgttcataaagcaataaacgagcattaattctggatgctgcagctagttatagtattttaaaatgtatatagtttgtgtgaaggctttatttttttgcctttgtggaaccattttgcatattatgggaatgggaactgttgacagaattttaagtgaacccagaagaccatgctgtggatattgagctttaagagaagcaatttaatgcttagctgaaagctgaaatctgggtttttctctccttttttggtgggggatggggtacatgtttattgatttattcttattttctaagaggaattcttcttgttaaaacagttacacagaatctatgaaattatactaattttaaattcataagaattcattcccagtgtctaggtgtaaccatttaagcagtaaaatattttagtccatttcattaagtagataagaaattatcgagtgtttcatggcatgaaataattcatgaagattgcagccaagggagtccagggagctatgtgataaaagcagagaactaaaagttagaagaccatatttttgtttcatctatttctgccatgtactagccatgggatttggacggatcacctttctgatcctctgtttagtcagccagagaatgaaaacattaacttcctgtttacctcccgggctcacttattcattgaacaggtgtgtgcaggaggcatcacacagggctaaggctaaaacatggaacacacggagttcacagtctcatggattatagcaaagagtacagaaagtggctgtgaaagcagcgtataaactataaagcaccatgggaactttagggttattcttaactctaatgaagttttcttcctgggaggttcaggttctctctctcatttgagtgataaactgatagaaaatgaaaataaaaagaagtggtaggtatgtctgtcagaaaagttaaggtgagatgtgccttgcacactcagagtaggcagctatttaatatttgttgcatggataaagtaatggtgttaggatttggaaattcagtgtaagcagataatgattcttatcttgcttgctgaattttcagaaatgttacattttaagaaaagtgggagttatatctggcactcagaggaatgtggaaatgagccacgcagaaaaatttaactcagaattcaaaatcttggtttatagagagtgcctgagtcagcgctatatacctagatttcacaatattaattagaagaatttaatgccattggaaagtgttaggcacaaataaaatatctaatgtttctgattgtgaatgagataaaatcccagatttaaaggccaacatgataattgaattatcttgaggaataagtgaaagtttggttcctgagattgtatttacacttaaagcgtgaaaaatgagaacttaagttgcagttagtgggaagcaacttgagcgatagctcatgtagcaataaagattctatactgtctgggatattttaaaattctacaacattgagtcagtttcagatttatatgagtatctctaataaacttcaaaagttctaaaggccttggactgtgacactttattttcatactcgtttgcacaaaatcccacatgttgacaggaataagcactggtgaggatgtgtgagggccgcttcatcagctccctaacagatggccttctccattcattttattctacaggcaaacatgctgaagacatatttggtgagttgtttaatgaggctaacaacttctacatcagagcaaattctcttcaagacagaattgatcgccttgctgtcaaagtcacccagctggattcaacagtggaagagggtaggtaattgcctgaaagcagtgagctagaagtgatgttgacaagatggtagtaattaattgcagtgtaattactgctttttccttgggatggcatgctgatatttcatcttgtctttcctagaagaatagcgagggggaaaaacctacaactttgtgttaattcacgatgaaaagattcatatgtggtctacctcataactctatactcttttttaaaaaattacaaatatagtatttgttttaaaggcttctttgaatacagtcagtattagaagccccaatttaggttactgacagttattttaaaaatagtttcttacctaaaacttacagagccactctagagatatggtccaactgagacagtgttacacataccttgtgtgacacaagcacctggtgttcttaggattgatgcctgtaaaatcctggtgattctgctgatttaaaaattttgttaaccttctcagaaatagcatttaccgaaagcctttaggctgcaggctttaaaataatgttaatgtcgacaagcattgtatagttaactgatagtcatttgatgatacaccctgaaattgtcagtttcaacaaaattgaaactatcaacgatcccttttttaaaattttactttcagtatcttgaatgaaagactcagattgagctggagaaaatatgcttaaaaagtacaaaatataccacttcatatttattttgagaaaaatatttaggttaaaatttagttttacctttaaataatggcagttaacaattgctcttgttgctttgaaaagatcctagtgtctgatttttgtgctatatctatagagtagtattggtaaaaataatgcttttattttttaaaaaaagtagttgtggaattcatctctcatcatttaaaaaatatatgttatctcatgttcagtctttttcaaaggtcaaaatttgattagtgaattacaaatataacaaaaatgtaaaacattgattttaatattcattatagaagcattcttacttttccaacaataagtattagttggtctgttcaggtaaggaattcttaacattttaaaccaatcattcacgttttaaattagctattcatctttcttcaactttttgttggctgttgccgttagaatgcttatgataaaccttaccctagaaaagattaattggtaaattaaattttatgagattttatagtacatgtcatatctttaaaatccttttccaaacaagattttaccttattactttccttgccatggatgttacagtagaaaaaatacttgactgacaggaagtctgtattctgttttggtcttgccacttttttgctggagtttttggaatcttaacatttctgaagctcagcttcagtggttgaataggtaggttaatagcctagtctgtccacctcaaaaagtttgatgaaagtcagatgagttggctgggcgcggtggctcacgcctgtaatcccagcacttcgggaggccgaggcaggcggatcatgaggtcaggagatcaagaccatcctggctaacatggtgaaacccggtctctactaaaaatacaaaaaattagccggtcgtggtggcgggtgcctgtagtcccagctactcgggaggctgaggcaggagaatggcacgaacccgggaggctgcactccagcctgggttacagagcaagactgtctcaaaaaaaaaaaaaaaaaaaaaaaagaggtgagttaataaatgaaatgtaaagtgctgtacaagcacaagaaagaactttacccagccccaattttctgaatccttagtgtaattttgtatcatcgatcaagctacttaatttttgggactagatacatgttgaaaagctttgccatttgccatctttccttaatgtttgtttcagaaaaacttaatgtgttatttccatttgtgtaatttttgcagaagtatttcccacatgcattatatttaaactaatgttgtttgaacggtgttttccttaggatattcaaatctgtgcatttacatgcctgttacattcataactatattcctatgtgatttctgagaaatgctatttaaataatgttactctagtattaggttcagtgaaataattagattactacaaaaaaaaagccatgatttgacctcatttcatagtgatagctattatctgtgaaaggaaaggaatgcacatgctcttaaacatggtttttaaatggacaataaaaaatattatttggttgttctaggaggtgtttttaattgtgagtcaaatggtatttacttctaaacagttaaaaatatttctatataactcaacttgggggattttctctaaatagtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacaggtatagcttcatgagtcccagagcctctccttgagatgaggggagagctgggcagagctgggagcaagctgatgcattgtgtgggaatgtccttgatggttcatctgggttaaaatcagaattgcttcaaactttgaaaataatgattgaattatatacaatgaaactactcattggtacataattattaaagttacagtatttcagcatattgatacgtttaacagtagaaatgtgagttctgattttaacttttagatgtagctaccttaagtagaagtgagtaagttgcataacagtattgtgtgtggttatgttgttgtttttagattcgaagtcaattaggaactgcataattcatttataatgcagcaaaatacctgtttcagcactgcagagacatttgatatttaattcagaaaaaaatgtattctgtagtgttaggggttttgaagagtgaaaatatagtcagcaaattaaccttctgttactggaaaatggtaggacacgttatcaggacgagacttccaagaaaaacaatggaaaataaatagtgcaaaaaaataatatgaagagactaactaaaaatgctctttctaaacacccctcctgccttctcccagctcagcactttcttcccatacctgctgtcacctcttgtcccatatccctctttcacacactgtctctccatcccttgtggtatgtcctgtcctctccccacctctgtaccctcttgtggagctcatcctttggcctctgacaagcacaggctgtggtgaccagtggtcctcacagccccgggccagctctctggtgattctcctgtgagaaccttccaggagcctgcgagttctccacttccattactaccctctcagcagtcctaccctcaggggccctttggcccatctcagggagtgcatagaatttttcttggtcctaattcctgtcctttctcagggtccacagggagatgtttggagccaccctttgttgcagctgtgctaggaaagtgcagttcaaactacaccactttctttccgcacagacagggagaggctctcagaaaaacaggccaaactgatggcagaggagcaagatgccacgcctttttatggaaaaagtagacttttctggaggttttagcacacttatttaaaaaaattaagaatatgtatgaatatagcattatgagccaaatattttaatttatggctttgcatttgttcaataggcattttcctggggcagtttcatttttacttagcagtgaagcctcaaacacaatgtaacatgtaggcttgctcatgaaaactttctacctgccgttgctaagaaacctcactggaaattctgttctaaggaaaaaaaatcagataacccaatgaaccactacattgattagatcatgataaaatatttgtagtgatttatagttgtagtgatttatagtatgaaaactgatttgactttcacatatatatgtgtgtgtgtgtgtattcagtcttatggaaaataaagcatatctttgactttttttttttttttttttttttgagatggagtctcgctctgtcgcccaggttggagtgcagtggggtgatcttggctcactgcagcctttgcctcctgggttcaagcgattctcctgcctcagcctcctgatatctttgactttttaatagtgtgtttaaggatagcagtgccagcccaaatttgctttttcattaatatagcaatatttggggtatataacatataaattttcacatttgaacttaaatatggcactgtaacaatattgtcttaatataagaagtacaaagtgactgaaaaaaaaatttttttttttgagacgaagttttgcttcactcttgttgtccaggcaggagtgcaatggcgcagtctcagctcattgcagcctctgcctcccgggttcaagcgattctcctgcctcagcctcccaagtagttgggattacaggcatgtgccaccaagcctggctaatttttgtatttttagtagagatggggttttaccatgttggtcaggctggtctcaaactcctgacctcaggtgatccacctgcctcggcctcccaaagtgctgggatcacaggcatcagccaccatgcccagcctaagtgacggaaaaattaagtgtttagaagctataggaaacaacagatgctggagaggatgtggagaaataggaacgcttttatactgttggtgggagtgtaaataagttcaaccattttggaagactgtgtggtgattcctcaaggatctagaactagaaataccatttgacccagcaatcccattactgggtatatacccaaaggattataaatcatcctactataaagacacatgcacacgtatgtttattgcagcactattcgcaatagcaaatacttggaaccaacccaaatgcccatcaatgttagactggataaagaaaatgtggcacatataccccatggaatactatgcagccataaaaaagaatgaggtcatgtcctttgtagggacatggatgaagctggaaaccatcattctcagcaaactaacacaggaacagaaaaacactgcatgttctccactcataagtgggagttgaacaacatatgggcacagggaggggaacatcacataccgggcctgttggggggtgagggacaagggggagggatagcattaggagaactatgtaatgtagatgacaggttgatgggtgcggcaaaccaccatggcacatatacctgtgtaacaaacctacatgttctaaacatgtatcccagaacttaaagtataataataaaaaagaacgtatctgtttatattcttgtcaaggttaacatttgcttacttaagtgagttcccgccttcatgaaggtactggctccattttttaaaaaacaaatgtacctcttatatgtcttaaattttgcagctttttctagacctctacctattcaaggccttggtatcttagggaaacaaattatctttttcacaataatgttattaataaaatctctatcatgcaggttgcctatcaattaggaaactaggaaaagaaaggaaggacattaatagtcaaaggttaaggtatagtgtgagttgcactggctcttcagtgattttcagacatagcgactagaatagccccataggcacccaggcctttgtatttgatggtaagacacttaacaggagatggcatagcaggggctttaatgacagacctttgttttcttctgaacaattaaattagccattgactgtttgggcataaactctcctatactcatttaactgattttgcttcccctgtgttccttaatgactcattgaaatgctgatatgaagtaatataaaatgttctgcctccttttgaaggtagtcttcaaaagcattaatagaaaacagtgtttactttgtatcatgatggttttgatcatgacttgatttatatgacagttttggacctctgctagctccatcattggttttatgataaatgagctacttatatgaagacttaaaatattctttagaccacagtaattgcctgtgacagtgctttaaaatgaaatggccacaggtgaataaagtttctgtgtaggttacttccagtttgaaaatacatagttcatcactatttttccttacattgatgccccataaacattttgcttctttcctaattgaacttatagatgttgggcaaaccttattgagaaaaagagataagagtacttactaatttttatcctaatgatattgaagctccagtgtagaagtgaatgtgttcttagtaagaatccatccatctctgtgtatggccccatgttggaataagcaaaaaatttcctgaagtgattgagatattataaattgctgaatatgagtcatgttgtgattttttttttctgagcaattttctatactcaattctaaatttgcaagagtacttttaacctacaacaggttattctacaacaggttgctattttatgttttcacattttttcaaataaggaaacttaaagacttaatatgtgtaggagagtttaagtgccccatgtagatgttataatttcatgagttcaaatcaagttaacattaacctacatataaaagtctctaacaatcttttcttccctgacttacaatacattgatttgtagagatgacaagaaggatgggctgaagttctatactgatccttcctatttctttgacctctggaaagaaaaaatgctacaggacacagaagacaaaaggaaagagaaaaggcgtcaaaaggtaaataatttcagtatgggaaatgtgcatatcagtgttcaaaggagattcttgtttagaaatagtaaattatttaaatggttgagatattggatatagtgctgaagtttttttagaggttgcatttctcacaaaagatcctgacaattcagtcaaacacagtaatactatcttcaataaatactgatatgttctccagcacttgctttgctttaacaaaagtagttcctaaactttgttttgttaccatgttttagtaactcctctcctgcgttctcaaatttttgtaaagcagtcagtattccatatcagatacaatgatcatgcagcacaatgatgtgcttttgtcttcttaacatttttaattgtttggttgccttctagctgtaattaaaatcttgggaagatgttcacatgggattgagaagcatatgtgatttgcacgttcagcggataggatttactgaaaatgagcctccctttaaggggtaggggtaggaagagaattgcaagtttgaaggttgagaaatatctgcatgcattacaagcagtcttcaaaggagaagcccactctactcaggttaagggatttgtgttttgaaaattgttcgttttgggcccagaaattagacttaggccactgagaggaataattctctaagggcaagtatttattaatatttttatatgtcagctgtatttaaaaatgaccatccagtttgctttacagattagagcgctttatttaggagaaatgcttagcattttgtgagttgatagccttagggttttgaggcattgaggtgtgttggcccagtaggagtgacagtttggtctggaggagaatttgaaaatcgaaaacagcattaaagggaagagaacatgagaacagtttgcagactgtgctgttgtaagacaccatggctggttccgggaaagaggatgcaaaggacttggtcacacacagtcttcttgtgctcatggctttgggagatttaattgggatatatcttggaaaagttgctaggttttgcagaatattcaagtgaagaaaaaagaaagataccaatcttttgagtggaaaaggaacaaatatttaaaaagcatatttaccttaatcctcatgcttttttatagttacaggggaaaatgctggggcttacctgcctttaaaatgtgcctgtttttttaaaaggccttctaggtttcctttctcaatgatgcttttggcaaaactgtttaattttttgccactcttcttgaaggggaaacaatttttatgtatgaatattatgtctttaaaatcatttgttatttcctgtgctgttttgtctcattctaccttcctcaaacacataaaattctgataagaatttctttcattcacttatataatgacttgatgttgaatgccttctaaatgctggataaacagtggcagaaaaaaacaggattaccaccctcatggagaggacaatatagtgagggacacaggccttaaataatcatgcagccctcggaaatgcagaaagagggagagaagtttcaaaatgttcatataggtccgcttcatatggaaatagaaaatgaggcaagatattctttatttcccaggatttcagaaacccaaatcatgctcaatttgcagttgacaaatctgaaggaaaaattagtttagaaaatttggggattaaaaaacccatgtttttgaacttttgtctcctttagtttaatgctttaaaagccttaaaaacttaattacacaaataaatatgaagttttaaatatgtagttacactgttggtaagtttagtgaaggacaagtacagagcactctgagtgagatgacctggtgtgtgacagtgtacacacagtgaggggtcaaggaagacctctctaaggaggtgtcatgcaggctgggttccaagggagggtagcagaagttagctcaacagtgggaaggtgctacggggaggctggagaggtgtggggggcagatgaggtggcgtgcttccgaattgaggaggcttctaggtagcagtgtctaagatcatcctgggggaggaaccagtttggcagcttctaaggattttaatgtaggccagtgtagctggagcctggattcatcactgttcatattctttcatgtttggttcgcatgcgcttgtgtgtcctgtgtgcatgttgataggtagatttggaggctgaaccatggtgaagaaagttgcaaatatcataacacttcatccctgaatttgtcagcatgcatcttttaaaaagtaaggggaatagttattcattatttttacacttgatcttagccaaaaggccgagaagcgattattcattatttttaatacgatggttcttaatcaggatgcatattggaatcacattgaaatcttcctcccccacttttttcctttggtttttcaaagtacacacccaatacatgctggttgtaaaatactcaaatagcactcccttccctgggagtacctagccacggttaacagcttggtgtgcatcttttaagaccttttagcattcataaatatttgcataaacattttacgaagtatttgtgtatacatagttgtactacatatgacttacatacacacactgacattattaaaaatgtacttcattctttttaatagttgtgtagtattctgaaatataaatgcttcataaattacccattactgttgctcttacaatactgcagtggttatccctctacttaggtgcagataattcttcaggataaatttctagaagttgaattgctcttattgaagagaatgtgaattttaaattttgaaagatagaattatattgcccgtaatctttaaaagactgaagaactagtttatgttcttaccaggccttctccagtcctggatattactttcttttgatgaaagattgaatgtgttacatcgtctcatatgcttattaaccatttctttatcttctgtgaatttcatgttcacatcctctgtggatccatgcctaaagcctccgggatgcctctgaaaacggtccagttttctgtcttcaccacacccttgggccacctgctgttctttcaccctatacccacttagtagctttctcacttgtgtccctatcttccctcttttaatttgttttctgtaacacagagagatcttctccaatgccttctcagcatgtcagccttcccttcttgttctttaatgggttcgcattgctgttgggataaaggcctctaaggtcttcctgcctttcagatcttgggccattcaccccaatgtaccatttacattcttttatttctttgagtgcagtgctatcctcctccccagagctctcacacagtctgtcctctcctcttggcaggcacctgacccatactcctctgcagaattgatgccactgtcaatacactttcaatactctcagtcattccaggatgcctccctgacttccagactagacacacatacacacacacacacacacacacacacacacacacacacacacgtatatatttaaacataaaaatatatttgtgaaaataaatacatttatttttatggtacatttataatagtacctttatttgtgtcctcttgtggactgcaggctccatgagcacagatgccatgtctgtgtgtgtgtgtgtgtgtgtgtttgccatttgtgttgtcagtgcctggcgcagtacctcgggcatagcactagaagttcatgcttgctgcctggctgtggatttgatcatttagccagcatgtattgagtgtgtattctgtgtaaaaacagtatgttgagataccataagacaagagggaaacgtaggaaataaagacacatgattctcatccttaaagatcataaaattttgtataggaggcaggaaaaacttagaggcacacatagaaataacttctcacgtttcaagaagcacctgtttaagaactaagtatttgttgaatgaaacattttctggccaagtagggctagaggaagaatggtgctttttatgagcaggtaagtttttatcttgcttaattttgtgttaaactatttacaggattcacttattccgtaatcttttagaaattgggaacagaatgttttgaattattttctttgaaagataattgtacgttaagaagtcagtcaaaattgtgtggtggcgggaaataatttctctttatggtgtttccaggttgttcacccatgtaatatagatctgaaagaccttgtttaggtttaaaacaagttacaagcatattcaagtgaaagtttttttactttaatgaaaacgatggtaagcaactcttaacagttgtagcagggtaactttttgttgattctgttttgttggttctgttgggtaagaggagtgcactgctttagagtttctgtaacattagggtaatcgaaatgcgaatgtgtcttgtctgttcatcaggcatgggccttgtgcattataactgcatttaaccagctgttttcctttcccttctgtcttggcatgctctctttcctttcctggacatcaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcaatagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatgacttaagtttttactttaataatcatttaattctttctcttagcatggaatgttgaatttcctttgccacttggtatctaaaaatgattggcaggtggtaaagtaactaaggagtaccttcattgttcctttagtaaccctttgaaaaaatgatgaacaaaagagagatttacttcttatttcagataacttatatattctgatttcaggagaagaattctattggcgtttacttaaaaatttattagcagttaagtaaaaatatttcttgcaggcgtgaatgatgtggtcattaagtcacacttgtcaccaaaggcattcattgaacaacaggaaatgactagtcaattttaacgtttgattcagttttctatttctgcttttgtaaagttgtagtcttccatttgcataaactctcatcggcatttaaaaatttgaatagagaattcttacaatatgtgatcaagaatgtttcaaaacaacagcaacctggactttgggttgtatctgtgccctttttttctacctttgtaaaactcagtgtttagcacaaactcttaacgtattacgtgccttcaatgttcccaccccagaaggtctataagtcattgggaggatgtgaggcaagttctggtaatttttctgtacaaacttctatttgttaaatattagagaattattggagctttaactgagttttagcctcatttgaattttagtgtgagtttatttctatagaaagtaggaattataacacagttctgctcatagttctttgggtggggaggaatgtatgaacttaatagctcccatgatgtcaatctgcttttttgttttttttctaaataatttagctatgattgtttactcgtgcaaaacgtatactttgtttttatcctatatagacttttcaaaaatagatgcagatgggaaaatgatggatttttaaaaatctctcagttgaatgatactccttctagcatctgagattattccatgttggatataaaatggatggttattcagatatagtctgcctttgtatttatgttgcttacatacatctgcgtttctcttaattttcaaaaaataagtctgattgttttatttcttcagaattccttttgttgtctcctactatttcccatggcttcttactatttgcatacattatttactatcagataaatagattataactcatcattgtattggattataacccttaatttagaaatttttatttttttttactacagtgtgtcacttttttattataaaataagacatgcttattatatctggaagttacaggaaaaaattaaaatgaaatatgatctatagtttcaccatgcagagaaaccgttgtatgcattttagtgtatttctctttagtctttttctatacatgtgtttcttttttcttttacaaaattggagtcatgccatgttttctttcttttgacttttagaaattatatcccatgttttaggtattatttcgcaacatgatttttaatgattgtatccgctcatctgagtgcatccaagatactgagggaaatttaaataccaggtttcatggtgtgtgtatatgctattatataagtaatataccgtaacccatcttacatttttgctctctctctagattgttaggaatggcttgttcctgagaataaatttaagatgagcgctgggaagtgcttgcctgctgtatgaccagctctctgtcactgccactcagggagtcgcacacctccatgcccaattgtccttgttttttctcatccagttctgggccctggtgcagatctctggctgcccgcctgtctacccaaaaaaccctgggggatatatcgacctctcacactgagtctctgctgctgtgcctacttcctcccgtgtggtgtcgcctctggccctcccggccctcctcctcccatgtcagcgttgtctccagccctcccagccctcttcctcctcctcccgtgtcggtgtcatctccggccctcccggccctcctcctcccatcgtccccggccctcccagtcctcttcctcccgtgtcagtgtcgcctctggccctcccagtcctctcttctgtaataggtgatcactgaccatcatgaggcctcgggatctccactcacctccaccttggccgtgcgtctgcagctggtttctgcctccccactgggagtggggctcatctccaacagctgcctgctcctccctcctcctcctcctgcctgctggcacatcccttttctgtggtccttccctcttcaactgaccagtcccctcttcccccagcccccgtcctcctgatgggcacccttcatcagggttctgccctgtagaaatctctggtttctacttcagatatttatcgagtcttccttcacttctgcctccatctggttagccccttttccttgcttcctttctaccctgtgttgcaaggctccttgatagggatcgccctcctagttatgccacagtatttatagtttcctaccctcatctcatcagaaagctgtccatgtttggctggagaactctgtttcctttaaaaggttgcactgtaagccagtgactcgtagtcatgcgcagagtcaagcacacatcatcagtgtctccaagggttataggaatttacatttttaaaatactctaaatctaaatacaggtcaggtccttcccccattaaatatatttttaagtcatttgctagcagctcacctagttcaaaagacataatcagaagtgcaccataatccagaattcatactgcaattagggaagaaaataatgagtagttattagttgttacacttcaattaaggaaggaaaaaggaaaagaagctgtctcttctcatttggaaggcttttctgtgccacatggtgccccagttaagaaaagctaccaactggaatcccaaagatggaaatgcagcgtgcatcttccctgctccctcagcacccccaatgtgtgtttggtatttccttcagagagagaaacacaagctgaaccctaacagaaaccagcaagtaaatgtgagaaaagtcagaacaagaaaagaagagtgggagagaaggaaaatgggcattgagtttatgagtgacgcaaagaaactggagcaggcagggagcgccaaagaggacagagtgcccagcgggtttgttgttttgctttctttgggttcccagactcagactgcccctgcttctgccgccatgagaggatgtacagcccctcctggccacatgtcctgtaacctgagccaggagcgtgtgactgtcttactaacgcccacggcactgccgggctgccacacttgggtccttcctctcctcctgagggcttagcaggaatcccgtccctgcaccccatgtctcagctctgctccactaatccaagatccctttcctttcggagtttcacacccagtttgtgtgcaaagaaaactatggaaagaaggcctttccatagtgcaccgcattgctttctgccctttttgttaagtacatttcttctgtttaagaaaaatatgattcactctactgcattctcgatttcttttcctgttcttactgttaatatttatccagttaacctgccattttatattttctaattatatgctgtcagtttcattgccactgaaatcttctgtcttatatcctgtttctaaatggaatggtttctttcatagccttcttagagaaaacgtatgctgaaatactgtgaaaaggaggctctgctgtttcctgcttgccggtctgtctgacttattcacttcaaagctgtgaatctgaatccatgtaacactggggcttgctgccgacttataataattatgttgttgcttggaatctctcacggggctatacctagttgatagtaaagcaaattaatgtctgatttttgtgtattagcaatgttattattcaaatacatccatgtgcctgttagccgacaatttttaaattaatttaaatttctcccacctcttgttttcaaatgccaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggtaactcagcatgccttgtaccctaatccctcctggccttgcatttgaatcttgctctatgtggtaggagaattttaactccggtattttagaggccaagatagagtcaaggatgactggatgtagatactagcaactctaacattctgtgtgaaataaagcaggtgcagcataagctcagacttacagttgagtctcaggccacactgtgcatgcatgtgtgttccctcacacacactctgggtgtttgaatggctctttaagccaaggcattgataaagggtattaagtgctgattttgtgaacctgtcccaaaccctcaagtttctggacacatcctgagtggaccacagaaaattgttatcacagacgagaagaccacaccatgcagctcctgtgcctcatttctcagacttgaccaaaatctgctttcgtgacctctgaccacccagacatcattctgccccaggccctcctgttccctgagaagtagaattcagagacttcatgttcaggcgtttatcaatttaggcacccacctctcttttttttggctttactctagtctttaaagacttcattcctcagagttggtgcccaggaaaattaccgtgtgttggtgtccactgctaacacgtgtctgcacacccctgtctgaatgacaatcctgctctcagaagtgctctccctggccatgcatgccaagtcaggatccccagagtggcttgaggctgtgtcaggccaagagagggcccatggtccagttagtttggaagaccctcggctgaatagaattcagcagatttcttggctgtgtgacttttcgaagcttttgatacacacctgggcactgcaggcatggggcatttccacggaggtgggttagagaatgtagaaagctcccaatctggttgaccttaggacccttaaaagacaagtttgtgagctaccgccttgagatcccagtgtgaagccttcactggcgctgccgtcctggcctctgcagtcagctgctttattctgcctttcttcaggaagtgctgcactttttgagtggtcctccttttggcacatttcagtagcagatcttgacttctgtcataatgaataatgtcaaactgtgaaaataactgacccaaggtgtgcatgtttgcatcctgccatgattgaagttcaggtgacaatacgtgttgtgtctggggatggctccgttaggtgtctaagagctcccaggacgtgaccctctcttgttcccttggtgactatgtgcctcatatctctctcaggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggtaagtggagcccccagacacacagcctgcctttcagcaagaggtttcttcatgtctccagccagctacagcctccttgtcttcaaatgactactcactacgttttttaaaatagagttaaaggggtcttacttgatttttttgttttgttttgaatagtagttgtgtttttgtccagtgtaaggtaatcaaattgtgataaagattgggaaacagccgggcgcggtgggctcatgcctgtaatcccagcactttgggaggccaaggcagttggattgcttgagcccaggagtttgagagcagcctgggcaacatggcaaaactctatccctacaaaaaatgcaaaaaaaaattagctgagcatgttggcctgagcctgtagtcccagctactcaggaggctgaggtgggaggattgcttgagtgtgggaggtcaaggctgcagtgagccgtggtcacgcccctgcactccagcctaggcgacagagcgagacccgtctcaaaaaaaaaaaaagaattgaaattaggaagtttttacttaccttgaaaccagaaacccaataactgaagtgatcgattaattaattggatctcttctctgcattctgctctaaggggaaaagtataaatgaaagaaagtgagctcatattaatgatttctttaaaaaaaaaaaagagtttgtgctggacttgtcatatttgcttgatgtcctaagccagtggtttttcagaatctataatattcaacagcataacccttttgtcagatgaaagtcccgcgttgaccccctgaccacaaaacacatggaaacagagcatctcaggtggaattgggtggggagtctgccctcgcctgtcttgggctgcccagagagcccctgggaacctccagcccacaccatggattcttaaccaggtcccaacccaggttggtcgagggtccctgacatgttatgggaatatccaagagcttctcgcctgtggggagctgcacagacttggtcacagtttagtcatctcatctggaagtgaccaagcaaggagcctggctgcagcccgccagctcagcatcagggatgtccttcagaggagctgtgatgctgctgcctctgcgtttttcttgtgtgcccatgaaccaggcccacagtgtggcccacgcacccttctaaagaccccagggtcctctgtgtacctggacatcattgacacacttttattttgtcaagataaaaaagtcctagaggtatattagctcatgaatatcaagttcggggtcattgtaggacggtgttggatttgccttttttttttttaacaccttataagccctgtctaccaagagtagatacataatctgtatctaatctcgaggaaacatctgatacacccaaatcgacagacattctgcaaaatagcttcctatattcttcaaaaacgagaaggttgtaaaacacaaagactgtgaagaactatccagattaaaggacattaacaaaattgacaaccaatgtcacggataatttccactggattctgaaccaggggataatcttttccatttgcaattagattgggtctttttgcaaaatttgaataatatttgtaggatagatagtagtagtgtatccaaactaattttgtgattttgatattttgggtgggcgaggcgggggcggtaacacatgaactattttaggggtaaagggacattatatgccattcactctcaaatggtccagagaaaagtgtctgtgtctgtctgtgtaaagatgataggggaagattgggaaataaatgtggtcagatgttagcagttggggaatccaagtatatgggaatgtttttctgctggtctcatagctgttctgtaaatctgaaattatttcaaaacagttaaaaaatgaatggataccatcttgggcaacattgcaagactctatctctacaaaaaagaaaatacaaaatttaaccgtgcatggtggcgtgcgccggtggttccagctactcaggaggctgaggtgggaggattgcttgagcccaggaggtcgaggctgcagtgagccatgatcgtaacactgcactccagcctgggtcacagagtgagacccaatctcaaaaaaaaaaaaaaaaatggataaacattaaatcatcaaatatcttactttgttactaagctagaaagtagatgattgtattttatgtttgtttccacagtaattgttgaaataaaggtttctcagttacttcttgggttagctgagagtgagtagcatagaacactgtttccaaggctctggatgctgttgctgcctagtagatgtcctgtggtgatagaaatgctccagcctgcagcgtcccagagagtagccactagccacatgtcagttcatgcttttaaggctatatgtgcctagtggctgctgtctgggatggtgcagctccacagttttctctaatggtgttcaggtacactgaaattaggaatttttaatattttaacacattactttgttacaaaaaaacttctcactttgaatgcatgttttttctcatgaaacttttaatattccctgagcttttctcccctcaaatttctaaaactttctgtccttagtgtcagtagaaaaaaaagtccaatagacatatttgttcgtttatctttaatttggagccagcaaaaggatgtgattctgaaccacgtgttgtgtctgcaggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccct

SEQ ID NO: 36526 - DNA, 19887 bp, Homo sapiens
gcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtggtgagtaactcgcctctatcctgtgcctctttcctcctgggtccttagtggggtggctagggcataggatgagggaacttacctgcccttctaagctcccatagcagtttgggcttagctggacctcagcatttaacacatcctattgtgattgattatatgtttgactcctcaccagacaagatctccgttaattcagtcattcgttcacacattcattcagcgcatactgagccttttctgtgtcaggcccagtgttagcctttggggaacgtgcaaagcatgagacaagtctaatccctgccatcctagagcttatgttctagggaagggggacagacaaaagaaatggttaggtgctcccacctgaaatctcagcattttggaaggctgaggcgggaggggaggatcgcttgagctcaacagttcaaggtcagcctgggcaacatagggagaccccatctctacaaaaaataaaaaaaattaaaaaatagctgggcatggggaagactttctgaagaccaagaggacacatgggagctgaaactcgaaggaagaaaaggagctggcaggaaaggagtgggggacacacattctaggcagcaggaagtgagccttcggaggtcctgcctgctccagctctgtgccccaaggggtctcttggagcacagtctcctgggacctgtctatgagtctgagcttagaggctcagggctgctccttcagacaggaggcagaaggcaggctttgggaactttgggccgcccacgcgccttttctcctcctctgcacctaggattacgttgagcaatacactttcacccccatggtctcttgagaccctggggaaaccctgagaggtgggtgcagtcatgtccaggtgtcaagtgaagaagtcgagggttggaggggctgagtgacccactcagggtgctccaccttttccagagctttgctgaacttagtttttagaacttgaagcctcgtttgttttcgttttgttttttgttgagagaggttctccctctgttgcccaggctggagtgcagtggcacgatcttggctcactgcagcctctgccttgtgggttcaagtgattcccccacctcagcctcccaagtagctggagactgcatgtgcatactaccatgcttggctaatttttgtatttttttgtagagacagggtttcgccatgttgcccaggctggtctcgaactcctgggctcaagtgaaactcttgcgtcggcctcccaaattgctgagattacaggcgtgagccaccgtgcccggccagaactccaagcctctcatctgtgttccataaatgcaatcagacacctcaggtctgggcccaggaaccccagctcttggttcatgtccggacagtccccaggggagttctgggttcaaccagcaagagctcttcctcctggctgatctggtcctcagccttggacagttagtccattaacctgaccccacaggagccccaatcccttggggtctggggaatcttgaactggggtttggggtgcaaatatctgcactgagtcacttaattgcacccagcctcattcctttatctgtaaagtgggctaagaatgctcccctgccttcctcctcggtgtagtacaaggaaggatcccatgacacctgctctcccagtttaaagctctatatgtatgttgtgaaattgacagggatcgctgcacaaacgctaatgcaaagtgggctcctgtgcttccttttctctttcttcttcttttttttttttttaattttcttctagagatgaggtctcactatattgcccagggttggtttcaaactcctagggtcaagcgatcctcccaccttggcctcccaaactgctggtattacaggcgtgagccactctgtctggctcctgtgcttgtgaatgtcaacagcaatcagcccttagctggcagggctgggttggtagggcgagagctcacccaaggctgcttttattaccctgcgtgaatctgcctggccccttccttctaaggaggttgctctgtggttgtcagtctctccctttacagctggatcctgatctttcagtttctaaccctgtgctgactcatcgtgctggaagtgagagcccggggtgaggtcagggaactcccttgcgcgtttcaagaaaagggaaaaggaaagagaggtgaggaggggggcagatgaccagagagacacaggctgagagagactgagacagacccagagagcctcacacattgagtgacagagacggagaaatggagataggcaccaaaaaatggttctcagtgacagaaagggaaaaaagcaaccccccagtctctcttaacatctggtgagaaaccagccatgtgctttggtctgggcccacacagcaaaggattatgtagggtttcatgctggtggatggtcaccttatagcaacaggtatctggggctgtcgggaaaacagacacgaggttgtgggacccagacccacagagatggagctgttctaggagctctggtcctcgttctggtcccctgggatatggcacagtgaaggccaccatcaggcagctggagcccagcagcaactgggaggcagtaaacagggaccgaaagtgcaaggttacctccgaggcaaactactctaagctaccctgtgctgagctcaagtcccttggaactatccctaaggcttccgcttccagagtgtttgagtattttcgttgcacagcttcgaataaatcccacagcaacaggtaaacggctgcaagctgtgactgttttctaagagctcatctcacaatctcaggtcctcttcatttaaacagagatggcaggaaaggcgttattttgagatctgcatggaggaagttcaccaggcagcctcaattcaccagctggaagtttgcgttgtttggaaatttgatgtgtaacacgttctgcatgtgggctgatgtttttgtaaacgggtagcacacacattcagcagggcaccaaagagcgggggctttgcagttaggtccatccttggctctgcagccttgtgtaagacatgacacgactttgaacttctgtttcctcttctgtgcaaagcaatgatgacagtatctacatcacaggactggcatgaggaccaagtgagattgggcaaggtgcccgggcacaccagtctcactgtcactgctgatgggcagagtggttgcctggcagtagcatcctctatcttcagcccaccacctctcttgctggctcactccaactgctctttagagatacacgcttcccctcttttctcctcccactgcctttcagtatggctgcatttccccctgcaagttggtgtgtgctgggtggaggtgggggtgaggacatgtattctctggagaaggccctggtaacgtcaaagcacttctttgctggtggcctggccctgtgacctcatttgtaccattttcttttctaagaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtattgccacactctctttttccatgtcttgctccacatactaagagatgggaaacttgggtactagtttgggcctgtcaccactttgtgggcagaccttaggcaaattttctccatctatagaatggaggacctttgtccatctatagaatgaaggggttggttggattagatcagagatgctaatgcaaggctccttttgctactactgtccatcatgtgtctgaggcagacataactaatccgtgactatactctttgatgatgagcccaggagcagcatctgactctatgctcccttagtgtgcctgaggcagatatcactaatcgatgactgcagtcttctacattgagcttagaagcagcatctgactctgtatgctcccctcccatgcatgaggcagacatcagtaatccatgaccgcattctttcatactgagcccagaagcagcatcttttcttttctttcctctcactctgttgcccaggctagagtgcagtggcacaatcttggcttgccccaacctccaattcccgggttcaagtgattctcgtgcctcagccacctgaatagctgggattacaggcgtgtgccaccatgcccagctgatttttgtatttttggtagagatagggtttcaccatgttggccaggctggtcttgaactcctgacctcaggtgatccgcctgtcttggcttcccaaagtgttgggattataggcatgagccactgcaccaatccaaaagcagcatctttgtgctcccttttcaagaggcatcacagagaggcctgttttggggtttgaatgagaggcgaagaatcagccatggagtgcctctttctcagactccctcttgagaagtggatgcaggggtggagagaaaagaagactaggcatagtggctcatacctgtaatcccaacattttgggaggctgaggcaggaagattgcttgagctcaggagtttgagaccagcctaggcaacatagtgagaccacatctcttaaaaaaaagaaaaagaaaaaaaatgagccaggtgtagtgactcatgcctgtggtccccacttctccggaggcaaaggtgggaggatcttttgaggctgagaaatcgaggctacagtgagccatggtggcaccactgcactccagcctgggagacagagagaccctatctcagtaaaaaaaaaaaataaaaatatggctgggtgtggtggctcacgcctgtaatcccagcactttgggaggccaaggtaggtagatcacatgaggttaggagttcgaaaccagtctggccaacatagtgaaaccctgtctctactgaaaatacaaaaaattagccaagggtggtggtgggcaactgtaatcccagctacttgggaggccgaggcagaagaatcgcttgaactcgggaggcggaggttgcagtgagctgagaacatgccactgcactccagcctgggcaacaagagcgaaactctgtctcaaagaaaataaataaataaaataaaaaaataaaaaaggagggggcatatgggtgaagtatggacaaaatagtggggcaggcacagatgatctggacacaggagcccttggagtttattcttgaatctaactgttcatctttattaaatatttgtggcatacacctcacaacaacatagccaacacacctccttttggagcttttatcaaagtttcccactgttaagattttttcccgctttgtgatgcgggtggggtgggtgctgtaagcaggcttacggggtggcagtttctcacaaaggcattaactggccttgtcctaggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattggtgagcagacaccatccgctgggggtggggagcagctgggagggctcatcagatgatattctccaatgagaatcagaactttgggttttctccccaggcgtctttcccaccatccattctgcccatctcactgcctacgtagaggctcgaacctgtccccatagccatccttgacccagcttttcccgcgctgcacacatactattgacaggtgtgtttcgtggttttttgttttttgtttgtttgtttgttttgagttggaggtttgctcttgctgcccaggctggagtacaatggcgcaatctcagctcaccgcaatctctgcctcctgggttcaagcaattctcctgcctcagcctcctgagtagctgggattacaggcatgcgccaccacacccagctaattttgtatttttagtagacgtggggtttctccatgttggtcaggctggtctcgaactcctgacctcaggtgatccgcttgccttagcctccgaaagtgctgggattacaggcatgagccactgcgttaggcccactgacaagccttgtattggctagccaccaagattgacttgattatccaccttcgggacaactggacagcctgcttatgacttacgccatagtctgtctctactagctctcctgccctgacttgacccagcatacaacagccagagccagccttttcaatataaacctgatcttgctggcactgcttaaaccctgcaggggcctcgcactgctccatggcccagcctgtctacccttaccttctgcccaggctgtgctcatccattctctgcctcccacacacctgccctctgtgggctccagccataccatctctcaactcataagccagttttttcatacaggctccctccatctggactggcttccctgcgtgcagttcactcctgctctacctttggctctgcctccacccatcctcagccgtctccagcattacctccttggagaatcctgccttgacttcccagccacccaaatatcactacttggtctgcattctcgttgcaattgcagtcgcatgagcaattgctgtggttgaggcccgaactgcgcagtgcctgtctgccatgggtctcctgcttcctctaagcacagtgcctgacacacagtgagacctcagcacgtatgggctgaggcaatgaaggaatgaaggatcccatgacccaaaagagcgtgttggaaagtgcaggccagggtcccaggtgctggcggggctggctgctgggtgggggcagagaggcaacccctctgtttttttccctctcagggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtgggtgagtaggtcagaccgtgccaaggccaggctggcactccctcagtccccaggtctgcactgatgacctccataccctggcccccacactcacctttccttggggctcctccgaatcaagtcctttagggacgaattggcgagggctcatgggtgatgcttcagctgtgagccagctttggagctggtaggtggatctcttgaggccaggagttcaagacaacgtggtgaaaccccatctctactaaaaataaaaaagttagccgggcatggtggcacatgcctgtagtcccagctactcgggaggctgaggcaggagaatcacttgaacctgggaggcggaggctgcagtgagtggagatcgcaccactgccctccagcctgggcaacagagtgagtgagactctgtctcaaaaaataaaaaataaaataaaactcccctagtgattccaatgtgcagctaagtttggaaataggtggtatggggtcaagtcctcttgggcctccctcctccagtccttctccctaacctctagccctcaagttgcagagtgatcagccaaaccagtttgcccagaaatgagcagtttcctgggacacaggattttcagagtccagacaaggaaagtcttgggcagaccaggttgagttggtgcccttagctgatctgaccatgttgcccttcttctccaagccctcctgtggttgtccatagctacaagggcctgaccctcaagcccctgcctgtcctggcccctttggctctccagctcattgcatgttctgtcccccacttcaagacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacaggtgggaaagagaccctggagccatggccaccctggggaacagtcaggggtggagtggtcaggtgctggaacacctagcccctccctgccggctgacttcctctctctcttcctcactctatcaccagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgaggtagcccaactttttgtggaagcacagccctttacaatctgctgcgcacccattgacgtcccagtgaggggaggttgcttcatcctgatttgctgagtcagcacaagattgtgggtgtgcatgggacacagcagccaaaatgtggtcatagcttctagaagctcacagtgtggggaggaagacagtaaatggagatccctgggcatatcgcttgtgtgatacccagtacagaaatgtttggatggatggatggatggatggatggatggatggatggatggatggatgaggagagacacattttggttaactctaatacaacatgataagccccagtagcagcatgatccaggctttctctgagagagggtctgaggacgtgactgggatttgccaattaagaatggagaaagaggccaggtgcagtgactcatgcctgtaatcccaacactttgggaggccgaggcgggtggctcacctgaggtcaggagttcgagaccagcctggctaacatggcgaaactccatctattaaaaatacaaaaaagtagctgggtgtggtggcgagtgcctgtaaccccagctaagctactcaggaggctgaggcaagagaatcacttgaacctcagaggtggaggttgcagtgagccaagatcatgccactgcactccagtctgggtgacagagtaagactatgtctcaaaaaaaaaaaaaaaaaatggagaagaaggaagctggacatggtggctcgtgcttataatcctagcactctgggaagctgaggcagatggattgcctgagcccaggagtttgagaccagcctgggcaacatggtgaaaccctgtctttactaaaatacgaaagattagccaggcatggtggtagacacctataatcccagctactagggaggctgagccacaagaatcacttgaacctgggagacagaggttgcagtgagccgagatcgcgccattgcacttcagcctgggcgacagtgtgagactctgtctccagaaaaaacaagaatggatagagtggagccaagaagaggcaggaagaacaaagacacagaggtgcacagagtttgggggaattttgaggaatggtcttgcaaaagagtgggatctgggagaatgagtgggagtggaaagcagatgaatgaagagaaggtgagcgcatcagggtaacagagatgcgttgtgaacaaatgcatgttctaggaagagccctctggagtgctaggtgccagagaggtgggaggaaggatactggaagcagagaaaccagtgaggggcctgatcttgggtggtggggaatgagggacaggggaggccgggatggaagccaggtggtggggaatgagggacaggggaggccgggatggaagccaggtttcagctgagcaggtggcggtggcattgatggagatgaggacatggggaaggacaaagtccaggtgtccttgagggaagacaagaagacaaataatccaggctctctgtcctcacaccagctgcccgcccctttcttcctggcacagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacgtgagactcccacctcccagtcctcaccccacccaacctcacatgcctgataacagggtcacagaagagacggggaacagaggagagggttccctcgggagagacactggccctgcttctgcttctacctgctcagctcctttcttgcccacggtgttatggaaacagggagccataggccagcattgtcactgagagagcaggctttggaggcagagccccccagttggaatcccaactctaaccagctaggttccaggtaggcacccacaattcaccgaggagaacagttgtgccccttccctgcagggccagtgtgaagagtccaggagttagtacacatagagatagtggcatgtgctttttatatgtgcaaggtccagcacatagcaagcgctcaacacagcgttgctttcatcagagtaagaactgttttttgtttgtttgtttgtttgtttttaagagacagggtctcaatcttatcacccaggctggagtgtaattgtgcaatcacgtctcactgcagtctcgaactctggggatgaagcaaccctactgtcctgcctcagcctcccaaatagctgagactataggcacgtgccacacaaccctgggtaattttttttttttttttttttgagatagggtctctgtctgttgcccaggctggtctcaaattcctggcctcaaaccatcctcacacctgaggcgctcaaaatattgggattataggtgcgagccatcatgctcagccagaataataactggttttttttgtttttttttttgagacagagtctcactctattacccaggctctggaggcccaactcgtgtttgtgtatttgtttatttttatttatttatttatttcgagacagagcctctctctttcacctaggctggagtgcagtggcgcaatctcggctcactgcaacctccgtctcctgggttcaagtgattgtcctgcctcagcctcctgagtagctggcgctacaggcgcgtgccaccatgcccagctaatttttgtatttttagtagagacagggttttactatgttggccagctggtttctaactcctgaactcgggtgatctgcctgcctcggcctcccaaagtgctgggattacaggcatgggcctccgtgcccggccatgtatttatttaggcaaggtctctctctgttatccaggctgaagtgcagtggcacattcatagctcactgcagcctcaaattatccaagtaacagggactacaggcatgcaccaccacacccatctacttttttttgagatggagtctccctctgtcgcccagactgggttgcagtggcacaatttcagctcatggcagcatctacctcccaggttcaagcgattctccttcctcagtctcccgagtagctgggactatgggcatgcaccaccatacctggctaatgtttatattttgagtagagatggaattttgccattttggccaggctggtcttgagctcttgacctcaagtgatatgtctgcctcagcctcccaaagtgccgggattacaggcatgagccactatgcctggcccagaataagaacttttattttatttgagacagggtcttactctgtcacctaggctagagtgcagtggcacaatcacagctcactgtagcctcaatcttccgggctctgatcctcccaccttagcctcccaggtagctgggaacaacaggcatgcgccaccacgcttggcaaatatttttttaaaattttttgtagacatgggattgcttcatgttgcccagactggtctcaaactcctggactcaagcgatctacccaccttggcctcccaaagtgctgagataacaggcgtgagccgccgtggctggccagaataagaacttttattatgaaataagtttggccctatcctgttattaattacctcaaagaggttggacaatgtccttacacttgcttctcaccctgagcttagaatagtttgagaatgagcatgtctggactgttgtttgacaggtcctgtccatgatgaaataagatgaatgtaattctcatgttatcagtggggagtccagcccagagaagttgaatgccttccaccaggtcacgcacaccacagacttctcccctagaatcatgggcctatctctgtccccagtgggagttcctggaaaacagcatcctgcatccagggagggcccacagttggttccttcgggtcctctaggctagagaatctcagaccggagaaatgcaaagactcctctgaagtacaaacattctcccagaccccaggttaagttatttcttctataatatcacttagatgtgtactgataattttattaaatataaagtctttggccagagctggtggctcactcctgtaattccagtgatttgggaggctgaggcaggaggatcacttgagcctaggagtttgagaccagcctgggcaacatagtgagactgccatctcttcaaaaaaatttttttaattagctgggcatgatggtgtgcacctataatcctagctacccagaaggctgaggtgggaggactgcttgagcccaggagttcaaggcggcagcaagctatgatgacgtcactgtcctgtagcctggatgacaaaactttttttttttttttaaaagacaaagggctgagtgtgatggctaacacctgtaatcccagcactttgggaggccaaggtgggcagattacttgaggccaggagttcaaaaccagccgggccaacgtggcgaaagcccgtctctaccacacacaaaaaaagtcctttctctttctagctctagacagctataaatccccaacaactttataaattaaatagaaaagtataaaaaccaataccattcaaataaggatgctctgcggaggtgctggcctgcactttagcacctccctgtattcaagctgcagtgaagcctgggcactcctggcctggctcagccacttcattcactatgagggccacctccgtttccttcctgtggcctatggcacataacgcaatgctgctgggcaccagcgcagtcactgatggccacgcataggctgagtgcccttgggagggctcagacccacagactgagattacccagaaccagctggtattcatgtttgaatattgtcatcaaaatgaaagacaattagaatttaacgtttttattcagagctcggggatctctgggaagacactgtggactccagtctgagaaatggttctcttgttagtgtgcatggatgcctcaactgggttcaggcatgaagactatgtttgaggcccctgaatgcacagcagagaaagctcaactgcagacacagatagacagatgtggagagaggtagccctgtgcagccacatggccctgcagagttaaggaatgggaaaagggctactctgtgacattccttagaacagtagtttcccttcgctaaagtcaccccaaatagggtggtggttgttgttgttgttttgagacggagttgcattcagtcgcccaggctggagtgcagtggcacgatctcggctcactgcaacctccacctcctgggttcaagcgattctcctgcctcagcctcctgagcagctgggattacaggggcccaccatcacacctggctagtttttgtatttttagtagaaatagggtttcaccatgtgagccaggctggtgtcaaactcccaacctcaggtgatccacccacctccgcctcctcaagtgctgggattacagatgtgacccaccgcgccccacctgtgtttcttaaaaccaaaaaaatccctctaagactgcaaccatcgataacttagggctgtattaccccagagagcactttgtagaagatgcgtttgttcacatcacttccctgttactttgacggtctcacctccttttcagtcatttgcattctcccagaacctgctcatttgttgttttttgtttgtttgcttggttttgtttttgagaagcagtcttgctctgttacccaggctggagtgcagtggtgcgacctcaggtcactgcaacctccgcctactaggttcaagtgattctcctgcctcagtctcctgaatagctgggattacaggtgtgcaccaccatgcccagcctaatttttgtattattagtagagatggggtttcaccatgttgtccaggctggtcatgaactcctgacctcaagtgatccacccgctttggcctcccaaagtgctgggattacaagcatgagccacagtgcctggcctgaccctgctcttttgaaagaccattcccccaaattctgtgcacctgtgtgcctttcttctctctgcctcctctcagctctgccccgctctcctcccttctcctctggcaaatcccactcatctcttgaagcccttcttccaggggaagccctgatcatgctgctttctcctgtgggagggatgaaggacgtggcccacggagtttgttttgttttgttttgagatggagttttgctcatgttgcccaggctggggtacaatggtacgatctcagctcactgcaacctctacgtcccgggttcaagcggttctcctgccttagcctccccagtagctgggattactggcatgaaccaccacacctggctaattttgtgtttttagtagagatggggtttcttcatgttggtcaggctggtctcgaactcccaacctcaggtgatctgcctgccttggcctcccaaagtactgggattacagggttgagccactgtgcctggcccaggcccacggagttttaagaggcttcctgtggcagtggcatccagacggagtgcagaaactcaaagttgaaggccagaagctcagggaagggggagtgtgagttgaggagtctcttggctgccagggccagaaaccgaactccaagcctctccacaacagcgggtgtagagcatgtagaatcagagaggaggctgagccatgcagccccgagaagaggggaatgccactgagccacagagacccagtgccactgccaggtgtctctgcctccacttcccatgaccctgcctgtctctgtatgcaggcttcaccctctctcgttgtacattgtacacattctaggtgacaccagcagcttctgattctcatcccccataacatcagccccccagagaggggacaactgctgagctgataacataatagatgcccctttcctggaggccatggtcatggtcagcgtggagaggatgaagcctgagcaggcaggatcgggggtctggaggggaaggaggtggaagttgagatcacagacctgtggccaggtggcctgggaagggtttgacgagtgtcggcccaaagagcttggaagggattttgctgctgtgggtgagcactgcctctccccttagggacaacagccacctcttctctccccatttgcctttcccttctgtagatatgaaacacaggcctccttgtcaggcccctacttaacctccgtgatggggaaagcggccggagaaagggagttctggcagcttctccgagaccccaacaccccactgttgcaaggtgagtcatggcctgacactctggatgtgtcccctaccccaagcttactcagccaagaggcttcatcaactcaccccagctttccctagcaccctcctgggccacaccttcacaaaatcactgatgctcaaagttggatataatatattgaactgaagccttagaatttttatgcaagttactgtggaaattctaggaaaccagacagattacaaaaaaaaaaaaaaactagaagaaaattaacatcacctaggatatactacctaggaataacgtcttttattttgagatggagtttcgctcttgttgcccaggctggagtgcagcggtatgatctcggctcgctgcaacctccgcctcctgggttcatgtgattcttccacctcagccttcctagagcccaagtggtctgcctgcctctgcctcccaaagttctgggattacaggcatgagccaccgcacccagccaaaattacttaacttttcttctagatactttttaaaaatatggcagtaagtttttcataaaaaatggagccatgctatccagtggaaatttaatgttgcccacatgtataacttaaaaatttcatatatgtgtatacatatatatgaaatatatatatatacagacacacatatatatgtatacatatatatacacacatatatatgtatatatatatacacacatatatatgtatacatatatacacacatacacatatatacacacacatacacacacatatacacacacatacatacacatacatacacacatatatacacacatatatacacacatatatatgtatacatatatatacacacatatatatgtatacatatatacacacacacatatgtatacatatatacacacacatatatatgtatacatatatacacacatatatatgtatacatatatacacacatatatatgtatacatatatacacacacacacacacacatatatatatatatatatattttttttttttgagatggagtcttgctctgttgcccaggccggagtacaatggcgaggtctcagctcactgcagcctctgccttctgagctcaagcaattctcctgcctcagcctcccaagtagctgggattacaggtgtgtgccaccatgcccagttatttttgtatttttagtagagacggggtttcaccatgttggccaggctggtctcaaactcctgacctcaagtgatctgcctgcctcagcctcccaaagtgctgggattacaggcgtgagccaccacgcctggcctgcaaacagacccttaaaagtcatctgttcctactcttgttatttaagttgctttgatactccacccctgaagaacttttatggggcacttaccatgtgtcaagcattgtggcgagtgcttatagagaaggtgggactttctgagggagcccacaaaaaagcattcttttcttgccctcattctgaataaattgaggaataaaaaataggagctacagatggagaccccaagtctggccagttctattactgataaagacaggagggtgagagctaggtggacccagccaggaagcagacctgggcagttgtagcctctatctccttccccctctgcccttgagtctagaaggaagcccgctcccaggagaaaaatagcgcccaggctacacatgcctagtttattcttcccaaatcaaccagttgcataaatcactcctctatcttccttggggtggaaagtggatgggagttataatttgagttctcttttgtcttagtccattgaagctgctattacaaaataccataaactgggtggcttataaacagcagaaatgaggccgggtgcggtggctcatgcctataattccagcactttgggaggccaaggcaggtggatcacctgagatcagtagttcaagactagcctgaccaacatggtgaaaccctgtctctactaaaaatacaaaaaattagctgggggtggtggcgggcacctgtaatcccagctactcaggaggctgaggcaggagaatcgcttgaacccaggaggcggaggttgccgtgagctgagatcacgccattgcatttcagcctgggcaacaagagtgaaactccatctcaaaatgaaataaaataacagaaatgtatttcttaacagttctggaggttgggtgggcagtcccagatcaggacactgacagattcagtgtctgatgggggcccactttctggtgttacctgctggctgtgttctcacatggtggaaggaacatggcaactttctggggccttgttttttaatttaaaaaaaaaaaatattttcctggcccttgcctgctgaaggaacctcttttataatggtacttaaaaatttttttttttgagatgggggtctcactctgtcacccacgctgagtgcagtatcacaatctcagctcactgcaacctctgcctccctggcttaagcgatcctcccacctcagcctcctgagtacgtgtgaccataggcccatggcacaaagcccagctaattttttgtatttttagtagaaatgtggtttcaccatgttgcataggctggtctcgaacttctgaactcaagtgatctgcctgccttggcctcccaaagtgctgggattctaggtatgagccaccctgctcggcctataatggcactttcctatcccattgatgaggctctactctcatgacctaatcatctcccaaaggccctaaggcctcctgataccatcacctttggggttaggttttaacatatacattttggggggacacagacattttagaccatagcacctccattgaaaggaaacatttctgacacctggctatctcaaagggccctttcagttcccctgcaggctgcattcccacatcaccaacaagagcagcgacactcactcagaggttaaataacttgtccagagtcacagcagtaatgaatgacagagctggggcttgaatccaggcgtcctcctagagcctggattctgtgtagtgagtgaaagctgactcctgggagacttctgcgtggtcctggttctctctccagactgcactgcgcaagtttctcttcctgatggtccctagggtattacaaagacagtggccctgcctgtcaggtgtttttattaccagatgaggtcatggcctcaggaaccctgtgggaagctgagttcagagtctttgagcaggctttagggaggttccagcttcccaccaccaagccccaggtggattcttacagactctagcctcagggtggggggtctggaagatgaggttgcggggtgcgatattctgcccaattcgcccctccttgctcaatctgtttctgcaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 36527 - DNA, 2227 bp, Homo sapiens
aggaagaggcaatactacccgagactagatgcggaccgtctctggcaaccaggaaaaggcaaatacaaagagaggtgagtgacaatgcctggtgtgtctcgggtcagagaacactagcaggcactagcaggtggctgcggcagggccgcagatcaaagtggtaactggggatctgagttcggcagtgacgcgcgtccctcacgtgaccaggagcctctatgtgcccaagtccctctcgtcccggtcttttttttgcctgtccaccatctccctattaccctttggtcgagagggaaagcagaagaagtaagttccctctaccctcttaaatcggtgtgagtgtcggcgctgcctagtaacccggggaatggggttgacagaatcgggatggcggagtccaggcctttccctaagctccagccccgccccccgcgcccacatttctgtgcaaaatatggtggtctttggggcggggtggggaggcgagtacctcccccgtcccccgggaggggggtacagacatttggaaatagtttctaaaaatgcttcgcttccacttctcatctgaaaagaaatggcaagctttgcggggtggggaggtgggagcacggaggacgaagcttgacgcaggggctgagacgaaaagagaacccgagagctaggggagcgtgcaggcagtggctggtgcccagaaagtggggggtggggggtgtcagtcagtccgtccctcctccccactccccgccccctaccctgtcttgcgtctgtgtgcaggtctgctggtcacagcggggcacctcgaggagaggacgactaggagcacacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggagtcgggagagccggagagcctctgggaaagcgcaaggttgaggacctggcccccgaatcaggaaaaggcaggtattggaacccacggcctgggtgttagtccagccgcttagtattctgactctattctgcctttcttgtctcctaagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaacttt

SEQ ID NO: 36528 - DNA, 21122 bp, Homo sapiens; identical to SEQ ID NO: 35724

SEQ ID NO: 36529 - DNA, 219524 bp, Homo sapiens
ccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggtaaacccgcaggcccacctggccgcccatcggcccctctctatcagggtcagggccctcttgcaggtccccgcaccatggcctcgcccctccgccgctcccctgggaaggttcccggtgagcggccgcggcctggggggccttggtgtgggcagaaggaagaaggacgcctaatcgggtccgtatccactagagtgatggcagggcagtgctggtgcctctgcacctcggcatcccatgttagggatagaggtaaaggtaaaggttagtgatagaggaaaaggtgatacttttcggcagctcttctccaaaaacaagagcccagacaatgaaagtagtatcagacaaagtgtgtgaatggagtgccaggtcagactccatgtgccactcacttactggttgcacacacagtgtggcaattattggaagttgataaggcgagaagtggctcaactggtcctgcccagacagaaacgtgtactgagtgccttcagatcacgttagcaatctggaaatccaagtcctctcggtttctggagtgacacggttaagagtctgggaatgcgtggtgggtggcctctgtcttggacactttgcatggcttggtagaagaactctgtcccagacatgggactgtgggtaaagccatttcttttctttctttcttttgttttgttttgttttgttttgtttttaatttggctttctggaagttaaaaaaaaattttgtttagagctgctctctttttattaaaggggaattcagtgtacaccctgttcagagactccttttcggatcctggtaacatttcattttccttcactggtgatgcaatataagcactcgggatgtctctcaaataaaaaatacctccgaatttatcattttgcttccacacttattttacagccaggtttgtctcgggattgttccttttgtgtgtgtgtgtgcgtgcgctttggacatttcctatttattcaggagtctgaaaatgccatcagtcagcacagaggtttgtttagttattttggttgtctctttggtggactgcatttcacattaagaacagaagctcagctttttccttgtcgtgttcctgatgatttgttgatcatattaatgacttaaagacatgatttatttaacaagttatagtcagtgtgagtgattttttttgtgtgtgtggtgacaggcaccttttacaaatctatgactgtgtgctatctgccgtcatgtagcattattaaattgtaaataattccaacttatttctttctttaaaataaatttaattgctagtttgattgttttttcttttcttttattattctgcaggtttgccacctattttcagtagaacaaaagtaaaatttgatgtgacaaaactatttgtgacttgtatgtgtcacctgcctactgtaatttatgaccaagttgtgggttgacacttaagaaggaccacatgagttgtataacctgtttgattttcctcaagttgggggcaagagtgtctattaagagtatgtagatggcatgagcaatccctgagcaagagtaattattgcctttactatgcttacatcaagaatttattattattattattattatttgagacggagtcgcgctctgtcgcccaggttggagtgcagtggcgcgatctccgctcactgcaagctccacctcctgggttcacgccattctcctgcctcagcctcccgagtagctgagactacaagcgcccgccaccatgcccggcaaattttttgtacttttagtacagactgggtttcaccgtgttagtcaggattgtctcgatctcctggcttcgtgatccacccgcctcagcctcccaaagtgctgggattacaggcatgagccaccgcgcccagccaagaatttatgatataacaatccttgtgactcctgttcacaaggttactaggaattaaggattaattcctacttcagaataatagtatcacaaagatcttctatcaaagataagatgtaacattaatatgttaaaagcacattttcaaatttgtaatacttgaactttttatctgcattatgtcaaattggatccacaatccagtgtaccaacttggaggcaatcgatggaataatcttttactcagttctaggatggttatctggtaccttatgggagtaacagagtttcctatgtaccattgaaactacagctatgggactttcttcatctgtcatacattcaagacctctaggcctttaattttgctagtagctcaggaatgttttggcttatttttattcttattattttgtaataaccttggctccaaagagacaagagtagattttacttccctcaacaacccagcctgtcacatgtcttcttcaaccacactaacacagaacttcatcatttacctttgggtagctgcaacaacagttttgctggttttatttccattgatatagttcattctacatatatatatgaaagagacaccttcattaattaacattttcttcacttttctattatccaagcatttatagtatgttattatttcctattatgtttaatgtaaaatcagtctgtcaattgggtttacagtcttctccaaatttatcttattcgttccccaatgtaggcttccacttaaaatatatttgctgaatctcttaattctttcctttttgtgtgtaatttctactatgaaaatgtcttagttgatttaataatgatctttctagggaagcatttcttagttatgttagtcttattatttaacacctctgtttttatgtattcagttgtactatataattttgtatttactaacttgtctttttattttcctttttttttttttgagacagagccttgttctgttgcccaggctggagtgcagtggtgtgatctaggttcactgcaaactctacctcctgggttcaagtgactcttgtgcctcagcctcctgagtagctgagattacaggcatgtgccactatgcccagctaatttctatattttaatagagacagggtttggtcatgttggccacgctggtctcaaactcctgaccttaagtgatctgcccgcctcggcctcccaaaagtgttgggattacaggcgtgagctactgcacccggccataagttgtatttttttttcttatttctttgattgtcatagggcaggagtcacaatatttagtacagtattttgctcagtagacattaaataaatgtttacttaatgaatgagccatgtctttatttttgtctttaaacagaactcagcttttaaagtgatagtttaggcattgtcctctttaaagtaattttgtgaaaataaattcacattgaagtctaaagtttagttcacttcctatgccattatatagtatgctgaaatgtagtcagaaaagttgaaatgtggtttaagcttgataatctcatgaaattttaattacttgctggataacctaagggaggtgcttcatcttggtaaaatcaaagttaacagtagatatggtatgaattcaaaaattttcaaaaaacttaagagaattaggatcttcatttgttatgattcatgtatgagtctaagccttactatttgtttgtattaaaatatgcatcattcaaggtaggatttcatcaaaacaattggggaagtaaatctgcctcatgtttatgagatttaatatttttctgtgcatagccctaactatttttgagatgcttatctttgccggttttatataaatgtgtctaatttaatgtttaatgttttttattttcagggatatggtctaatatagatgagttgtgttttaaatttttttctcaataattttcatgtgactaataatatttcataaattgcccttcaaaattaaaattctacacataataaaataatcatgcctattttttattctcaattagtttatttccctttgcaatggtagaaaacactaattgatagttctatcataattgtgcttacatggtttctatatcttaagagtaaataataacatgacccataagtaaatctccaaacaacaccactcttccatattttaggcagtttggttcagtataagtcatgtttaagagttacgttccagtagaagatagtgttttatcgaagttaatttgggtcatcattactaacttttacatctaaaaaatcagcttttgtagctgtttgtttcctggcatgacaagacctagttgggtgtgttgtaagaaagagagagaaataagattcatggcaatgaaggaaaagtaccctaaacctctttttcttcaatgtaaactagacctgaatgaattattcagaaaatttcatccaaccacattctctagagttgcctctgcaacgtgagaaactgatttattatttaacatagaatcccacttatgtgaaagtcatatacagccaggtacctctgtatatgtttgttaccttgctgcagtggaaacaacagtagtagtatagaatatcacaataacaaaatgtgtgctgtaataagaaaggtgagtttgatatggtaactcttgagacaggtgatatggagtataaaaaatattgaagaaaggaatggatttgagattttgcctttttcagctctgatttccctctaacttttggacaggtaggggagaatgtgatgtaaaggaatggacattctaaaactttgtgcctagaagaaatgagcccaagtcccaagcctcccaattagctgtgtgatatagcatctgggaaggtcctccttgctacatcatcccatggcggaaggcaagatggtagagggtgagaaggagcaagagagggctgaacttgcttttataaaggaacccactcttgcttgcaataacgaacccactcctgcattaacaatactagtcacctcataaaaatcccacctcttaacacagttgcattggggattaacaacacatggacttttggggacagattgaaaccatagtaggaagtcaggtaatataataatgaataatgttctctaaaaacatgagaatataactgctagagcttttctactaatatacagaccctggatttaaaaacactggtattattttttcaataatcaggtaatggttgagtaagaacatcggcaaaaatacttgtgtgtttgatatggtttgtctgtgttcctacccaaatctcatcttgaattgtagttcccataatccccatgtgttgtgggagggacccagtgggaggtaattgaatgatgggggtggttacccccatgctgctgttctcctggtagtgagtgagttctcacgagatctgatggttttataaggggctttccccccttttgctcattctttttcctgccgccatgtgaagaaggatgtgtttgtttcccctcccgccatgattgtatgtttcctgaggcctacccagccatgctgaactgtgagtcaattaagcatctttctttataaatttcccagtcttggatatgtctttattagtagcatgagaacagactaatacagtattcataccaatgttagtaattatgttatcaggctagttgtgatggctcacacctgtaatgccagatgtgagccacctgggaggccgaggtaggaggatcacttgagcccaggagttcaagaccagactgggaaacatagcaaaatcccatctttacaaaaaagaaaaaaaaatacaaaaagctgggcatggtggtgtgcacctgtagtctcagctacttgagtggctgaggtgggaggccacagtgagccatgatcacacccactgcactccagcctgtatgacagattgagaccttgtctcagaaaaacaaaacaaagcaaaacaaaacaaaagaataaaaccttagagatccagaggctgaaggagttctaagacttccattgtactattaggcattggccctttaagcttagaatatatttaaatacatttaaattgtctattcagagtcttaagatggccatctagtaagtccaggagagaagccatagaataaaatcagccctccagacaccttgattttggacttctatccttcagaactttgataaaataaatttatgtttaagccacccagtgtgtgacgctttgttgtggcagccctagcaaactaatgatatacttctgtaattgaagcaaaatttcataatacagcactttcccttgctttgtttagtagacattttctggactttgacaggaacatgtaggtgagaagcagtaatgatctaatcagtcaggtttgcttgtagccattgccaatttttgacaatctctgtcttttgatttttgtgtttaggccatttacatttaatgtaattgttgatacacagagagataaacagatttctatcatatcataggtgtctgttcccttatttttcattcctctatttctcctttccaacctaatttttaattacttaaatatttttattattccattttgatttattctgtgagtttttgacaatatttctttgtatagcttgtttttagtacttggtctggtgattatgatacacataccgaacttttcacagtcaacttaaagttaaaatttcaccacttcaattgaaatatagagatcttaccattatatagatctcattaccttcctctatttatgttgtagttatatgtattatatcctcttatatctctatatatgtattacacaaatatttttaaaatagtaatttaatgtaatgtttatacctttttttttttttttgagacagggtcttgctctgttatccaggctggagtgcaatggcgtgatcacagctcactgcagccttgacctcccagactcagtccgtcctcttgagtagctggaacttcaggtgcacaccatcatgcctagctaatttttgtatttttttgtagagatggcattttgccatgttccccagactggtctgaaactcctgggctcaagaaatcctcccactgtggccttccaaagtgctggtattataggtgtggcctgtaacttttatttatttttattttatttatttttcatttttttttgagacagaatcttgctttgtcatccaggcaggagggcagtggtaacatggctcactgcagccttgacctcaaggctcaagcaatcctcccaccttagcttcctgagcatctgggactacaggcatgtgctaccactcctggctaattttcatattttttgtagaaacacaatttcatcatgttaccccatctagtgtcaaactcctgagctcaaggtgtctgcctacctcagcctcccaaagtgctgggattacagatttgagccactgtgcctggccctaacttttgtttttaactgtcacacatattttaaagagtttaagagggaaaggataatctattagagttatccaggtagatactatttctgttactctgtttcattccccatgttctgtgtttgttttggggtatcatttctcttccatttaaagaatgtcctctaacatttttttaaagcaggtttgctggaaactaattgtcttagtttttcttcctctgagaatgtctattttatcttcatttgtgaaggatattttcaatagttatataataatgagttgacagttctttccctttaagacctaaaaaaaaaaaagccatttctcttcctcccgccctttctttttcctgatgagaaatctgcagtcattcaagttgatatatgtttgtaatacatcagttttctctggatgttttaatggtattttatttttcactttcagaatcttaaatataatgtttctgggtttggaggttttggggtttatcttcttggggttttctgagcttcctgattctgtaagtatatgtcttttatcaaatttgatatgttttcagccattattttctccaaatatttttttctttctcctctctttctgggactctgatgatacaaatgttaggccttttgatattgtcctgaggctctgagcctcaggtgactatatgatagtatcaaaaggcctacttttttaaggacttgttttctctttattttccaaactgatttgtttctaatgattcagctttaagttcactgatgctttctactctcatctcaattctgttcttcagcccatccaatgaatattttattataattattgtatttttaagttctaaaatttccatttggtatagcttttatttcttgtccaatactttctttccatttatttagaaagactttgcccttatgttcttaggcatggttataataactgattgtaagtctttgtacattgtacagaaatttcaaggtctgacacctcaggattggtgtttgcttattagtcttttattttccaagttaacgttttcctgtttctatgttgagtgattttttaatctattctggacatttgcatattatgagattctagctgtcagttgtatcttaaggggaatactgttcttctttgctttagtggtcactcaacctggttaggtgattttgcaagttggacccacctgtggcctgcggttccgatatcaatttggttttcaaagtctactcagtagtactgtttgtatttgtccattatgtgtaccgcccagtggatagtgtgggatctgtgcagtagtctatgctatagtttacttctcaaagcctttggtatgctgtttaaggtcaaatctatgcacgtttagctcaaaagtgagtgtagaagttaatatacaactttatgggattgctctcatgagttcccttctttctgtgatctctgatattttttgtttccatgaggaccccctttccagtcctcatggccggaaaactgggcttttgttttcctgccctgctgtgtacttcctccagatttatttgcatctgatgccatacgattggaagacagagagaaagttgcaacaggcatttgacctacgatcttgagaccagctctatatcctctggtaaaaagaatgattcccttaccttagaattttaggcatctgtcgtggttattgcttctgccatccccgtgggattacctgggagttgggactagagaggtggaaaagaatattggatgttcttccttctctgacctttaagcaccccctttctgattcttggaccagaaagataaggcttctcttggcagtctttgtacacaatcaattgcacttccagcttttctgctgcttttgagtcaaggccagttgattacagcagagagaaaaaaaagccaggccatattggaggaaaaaatgccaggaaacttaatctggttttgtcgtactttagattctaatcttcttccttagttcttctgctatcatgtatttttcagtcttcaaatagctgctcaacgcattctatacaaggattattgttggatttagtgggagagacaaggtatactatagctaccactttgcacagaaccagaccctcaggttgttatttttaaggtatgaatgtgtgaaactcagtctaacttgattttaagttcggagaagaaaaataccaggcaattggttcccaaatgtacactcaacattttttccctttttactgggtacatagttgctataccaatcaatattaataataaagattattgtgtggaaatggttcatgtaagacaaaaactctatacataatttataaaatgtctgtgttctaaggatttagaaagaagttttgcctttttgatatctacatacttcatttgtgcccctttttgtgctgtgaaggagaagagcaagttcgacgttcagaatttctttggggttccctctcttggctttgggccccccctccctgtctgcatacagggaagcttctttctttctttccccttcttttgtgcctattaaactgtccactacttaaaaccaaaaaaacaaaaaactaaaaacaaaaaaacaaaaaacaaaaacaaaaacaacaacaacaaaaaaacccaacaacaacaacaaaaatttctctgtggatgtgggaaggagtgttatactgttttgcatcatagatttatctttcaacatagttgctcttagggcctggaatgtagtaggtattctgtaataatttgttgaatgaatgaatcagggattattcttgaagtaacactgttttaccttgcagatattgctataacctctcaggagttcacatcctaccttgtgggataaatgcacaataacctcttttatatgctgttgaatgtgtgttggagaatctcttttccttaatgggtataaggatgaccactatatcatttaggattaggttttgctacatataacaaaaaagcaaaataaaagtgagttaactaagatacagcttaattaagataaactgttctgtgggtccacaaagtcatcaggaacgtaggcttctcttttgctgctctgtcatcttcaggatcacttcatggtcctaactgagtatgtaggtctaaagataccacctacagactgggcgcagtggcttatgcctgtaatccaagcactttgggaggctgaggcaggcggatcacttcaggtcaggagttcgaggccagcctggccaacatggtgaaattccatctctactaaaaatataaaaattagctgggcatggcggtgggcgcctgtagtcccagctacttgggaggctgagacaggagaatcacttgaacccaggaggtgaaggttgcagtgaaccaagatcgcaccactgcactccagcctcggtgacagtgcaaggctccgtctcaaaagaaaaaaaaaagataccacctacacattccaagatggctgctggaagaaatgagagaattacaagaaggcctgcttttcagtgaagtcccctcttttaaagtagccttccccacatttcacatgatacttccacttaggactcattgttcagtactctgtcatatggtcacatataactacaggggagtcaggaaatgtcttttatttaatgcattgccaccccaaataatattaggattctgttcctggaaaggaagagggaaatagatgttgtcgtaggcaattagcagtctctaccatagccagagctgccagaagcaaaaggaatgagatttaataaatgaaaatattaaatatgaatgtaatattcttgaaaattgaggtgaatggttcttaatattttaaaaatagtcttatagattcgctttataaaaataagatataataatgtgaaaagtatgtctgccacttctgtgtctgggctagctggttcccctccctaaaggcaaccactgttgccagtgaccagtgttttcattatatactagagatattgtatgaagtattttttaaagttaattttcataagttaaaatgttattgatacaggacatgaatcagatatgcccttagtgtggtagataggagataatgttataaagaaaaatgtttcaggtgggagtatgtatgtgaattttatagagacaccgaaaacagattaagaatcatgatatcaggttgagccatctatgatttgcctggtagtctgaaactagttctgaagcattgttctacccaccaccttttgtttttttaaaatctgagctagccttagtatgtggattccttaatacggtgagtgataaacatgcgggttggctattgctaaactcacaacatttttatgaaatggaataactagtcaggaaaggtactggggcttcccatacttaggataatgtttgaaacttcttacctggttaactaggacttgcccactcaggttcgtacctttctttctagtgctcatcttttatcatttctcacagttggtgcagtttccttccctacgctttccctgagaagccaagcttttctgcattaggggttatatacatgctgtttcttctctacctacccccaacttttcacctggtcaactgctactctttctagtcatccttcagattgcattttgacattactcctcagtgaactatttctctaactgtctaaattaagttcttccttttcttttccctgtacttatcacaattgttatagttatttgtgtagcttttcatataatatcctgttaagctctttatattgtaagcctaatgagactatggatcatacctgacaagccactgtttcgttggggtagttcctgtatgcattgtaagcattcactcaatgatatctgtgagtgtgatgattaattttatctgtcaacttgcttaagccacagggtgcacagacatttgttcaaacattactcttgtaactcttgtagtgtcagtgagagtgtttctggataagatgaacatttgaactgagtaaagcagattgccctccctaatgtgggtgggcctcatccaatcagttaaaggacgaaaaagctgagtaagagggaacttctcctgcctgactgtcctgaagctgggacatcaaatttttcctgcccttggactcaaactaaaatgtgggctcttcctgggtcttgaacctcctggctttcagactggatctacaccattaccattggctctcttgggtctctagcttgctggcagcaggtctttggacttgtcagcctccataatcatgtgagccaattatactatttctctcataataaatctcttcatatatataaaggttcagtttcttaggaaaactgaccaatacagcgagcttcacaaccgcccataaagtaactgtaaaagcagagagaaaacatttctgcaaatctccacagtggatctgaagcaagaaagccatcttgtggtgtttctgggaatatcatgtctgaggtatatatcccttaagaaactgaaacagtcctctgcaacagttttcaacatattttgtgccaaaggcacaaaagttggaaagttgatgaagtctgtggtctccttaaatcaatgattttaaataaacagtatacataatattacaaaggaaaccacttgtaattaaatataggtatcaaaatattaacaaatatatttacaagtgtgtattgtaagatatattcctctttattgaagactcatatagcaagataatatatttaaatatgggcaatttaaagtaaagttttattttttaaagagatcaatatcaaggttgtctgcatgactggcctgtgtgcctgttcatgttattaaaaaaagttgggcctggcgttgtagctcatgcctgtaatcccagtactttgggaggccaaggcgggtggatcacaaggtcaagagatcgagaccatcctggccaacatggtgaaaccccgtctctactaaaaatacaaaaattagctgtgcatggtggcacgcgcctgtagtcccacctgcttaggaggctgaggcaggagaatggcttgaacctgggtggcggaggttgcaatgatccgagatcacgccacttcactctagcctgggcgacaaagtgagactccgtctcaaaacaacaacaacaacaacaacaacaaaaaacaacaaaaaaaacatgttagttaggcacagtggctcctgtaatcccagcactttgggaggccaagggaggaagactgcttgaggacaaaggacaggaatttgagatcaatcagggcaacatagtgagaccctgtctcaaaaaaaaattttttttccagatgtggtggtgtatgcgtatagttccagctactcaagaagctaaggcaagaggattgcttgagcccaggaattcgaggctgcagtgagctatgattatactaccgcactctatcctgggcaacagactgtctctaaacaaagcaaaacaaagcaaaacaaaaccttattgcagatctaaagctacagtaatttcaaagtaatgaagaacatgaatgttatttccagatacatgccacagatgtaacatggcataaaaataattgttatttctattatgacaaagacacagaaactacttttttttttttttttttagacaaatctcactctgtcacccagcctggagtgcagtggcatgatcttgactcactgcagctttgacttcccgggccaaagacatcctaccacctctgcctcccaagtagctgggactacaggtgcatgccaccacacccagctaatttttttctactttttttttgtagagatggggatctcactatgttgcccaggctggtctcgcactcctgagctcaagcgatcctcctgccttggcctcccaaactgctgggattagaggcgtgagtcactgtgcctggccaggaactactattatgtctcttgtttatttcatttaaaatggaaggaaatactaaatctcatagagtttgtgaaaaagatgtccaagttcaggcctccttaattactcatccataccttgaggatctgtgattaggtctgtgaattttaagttaaaagcctctgatagggggctaaattggttcttcaccagaagcactgaccttggtctctgaaaactgattcttaaactcagaggctttcagacaatactgaaatgtgaagaataaaagtcaatattcatgtagcatgtgcatattagtgactttattttaaaactttgtaccataagcatttatataacactttataatttacgtaggatgcaaaaacacctggtctcatttttttcttcccaacaacccagtgaaacacacataacatgtactatgtgttcagtaaatagttgattagtcttatttagcagatgcaataattgaggcaaatctccatttaacccttaacaccttaaatatttgctcaaaatcaagtgttaaataatatctacttgtgactcaaacttgacaaatggtataccctttagtcttatgttgctattcagtcatatttgttggtgaagtgtgcatctaaatttctagtgtatggcttattacaatctattaaataccaaaaatgtactgaatagctgcctacaacaaataattgtctgtcctaaaatgtcactagtaccaagattgagaaacctggtcaagatgaaagtactttaaaaaatccccataaactctggcacttatgctgatatgtagatatatattttggtcaaaccaaagttgatcttgaatgcctggtttaaagtcaatgaaaaaacttgttaatagtggattagtttaattaaatgatttcctaaggtatatgtggaaagcttaattattatttgggagatttttaaatcatgagcactctttgtactattgcataaataaatctttgtttgaaatttgaattcggtgatttggttattcaaaatagaactacacagaaccgaactacagagtactgaaaatttgtttcacattaatgtatttatacatccatttgcttatttaaaatttattaaggccctgctccatcccgacattgtactaggtgctgtcatacaaatatgaatagtatagtgcctgtcttccagacctgggtaaaatggcaggtaagcagaaacaatgaactatgggacattctatgatagaattatcccttgaaggagatcattattcaggaataggcaaaggacacaggaagaaacagacatttgcaacttcgtgtgtaaattaattggtaattaaatgtgttggaattgctgtctaatgttcatagtctgcagattcttctattagcttgaagagttaagaaatcaagacacaatagaggattattttataattctgatctttctggttcattatatgagtaatcactatacacactatcataggcatagaggattttgtcacatatataagattttaaaaaatagtataaaggtacgtatgataactaggaagtctattggcaaccagtggtttatttggattattcatacacgtttcaattgaagatcttaaattttgatttttcatcatttgtgtccattgctagtttcaggtatttactgagaagtctcaatctgcttatttaacagatacttttctctattggtttagtgacagtgaaatttgccttacaacttgttatgataaaatagtgctccatcttgctgaaaagcttttgaaatttttcaaatgatttcaatgatttcaagagatatatttgggaaaatttagtgttgacattgttggctaacaatttttcagccttacaaagaatctataacgatcagtaataagacttttaagtgagaaatacttaaacctctcatccaatgttttaaaaacccatttgctctcttaggtagaggtgttctttctttttttaaaaaaaaatttaagcaaacatgtcatttaaatcacaaaattgttacacttgcttatatcctatattcatacctcaatgaaataattttggggtactataaagtgatattttgctgtaaattttagggtatcaaaggccaagacttagctgaatatattttagatatattgttataatcattaacaggttaaaattactttatatcagatatgagtaaaaattaattactatggaatgaaagcaaatgatcttttgtgtaaagaagctgtgtttaatatattgttggccttaaataattggttttctgtcctttaaaggagactaataaagaatttgtttgtatagttaaatgcattcaaagtaattatttttatatgattattttctgatgtaaactttaccgtgtaaatacatatgtcatctggctgattttttttgggggggaaatgaggttggataccaccataaaaataaatttttttagttttttttttttttttttttcaagatggggtcttgctctgtcacccaggctggagtgcaatggtgtgatctcagctcattgcaaccttaacctcccaggatcaaatgatcttcccacctcagcctcttgagtagctgggaccacaggcatgcaccaccatacctggctaatttattttcaatttttgtggaggtagtatctccctgtgtttcccaggttggtgttgcactcctgggctcaagccatccttctgctttaccctcccaatgtgctgggattacaggtgtgaggcatcatgcccagccaattctagaaattgttatctatattatcaattagaatttaaaaataatcatttccaaagaacaatttttggcactatagaagccttggaggaaggaacccttcagtagaatgtgttcagggcaaattagtatcaattctcttaatgtagatgtaaaatatgcacataaactatgttaataaattgaaaatatgacacttaaaacaagctcaattttatctctttcagaataataaataataaaaatataaagggtcctctttctgtactctttatatataaataattttctcccccaaattagcattaaaattaattctaaaacttttttgatatgaagaaataattttaagatagatctactatattatttgcaaggtcacattaataaaatatatataattcatttgaaataaaaaattaagaaaaaattttcataaaggattcaaagacaatcatattagataaagaatattttaggctggatgtgcgagccactgtgcctggcctaaaatattctttgtttaatttgattgtgtaataatcctaggactttgggaggccaaggcaggcagatcgcttgagctcaggagttcaagcctagtctggagcaacatggtgaaacccagtctctaccaaaaaatacaaacacaattagctgagcatggtggcatgtgcctgttgtcttagctacttgggagactgaggcaggaggatcacttgagcctaggaggtggaatatgaaatatatcaataatttgctaaacaaatttttagtcattgtaattatatttctttttaagtaaagagaatattagttactgaattgactctatagagtctaataaaattcaatataatgaaatttacttttggatgtacagttctattagttttgacaaatatgcaatgttgtgtaatcaacaccacaataaggaatggttctatcactgaaaaacattttctttttgctccctctttgaagtcaaacccttttttccactcccagtccctggcaactactgatctttttctattcatataactttgctttttcagaatgtcatataaatggaatcatacagtatgtagccttttgagtctggcttctttcacttaacatgattcatctatgttttgtgtatcaatagttttgtttttttactgttgggtaatatttcagtgtatggatataccttagttttatccatttactagttgaaggacttttgttgtttcaaattatttgcaattattactttccatttgcctttctaccatttttaaccttccttattctcttttctgctttgtcttctccaaaatgtactataacaagtataattaattaatcattagttagttaatccgacacatttttttgattgcctatgaagtgccacacaagtattattctagacactagagattacactagttaaacagaacacacaaaccatctctgccgtaatataatcatagcctcaaatatttaaattataagttctgttaccataatgaattttcatacatgtatagattaattgtcttaaagatctttatgaataagataaatgtttcctttttttttgcaattcagcttgatttagtaatttttcagggaaaaaaagtcattcattggaaatattaaggattgttagtgcggaatacagaatatatttgttctgtttttatggcaatagtttctgataaattactcaggacaaagtttctttctcagttatgcttgctccctgcaaatatcatttctaatataagtccttcgtcatgtcaggaattttcttttcatttctgcttgacagtctcagttttgtcaagaagatatacataggttaattagcacagtccagaagaatagttgccctgtttgctgcccttagcagtgaaacaacgtaccattctgctgtctagggatctagtccaaaggttttataaggaatagggaaagcaaagaaaagacaaaaaaggagaaaaaccaggatcaaacttagcatatatgaggatgtctttagagaattagatgtacaggtggtctggaaacctaatatatctatatagacgtctgatatcttcaactacatgaaagacttggtagaaatcaaatgacagttagaacctgcatgtataatttgggttaattatcctttgttggataggccctgcaggataatgctaaggtaaaaattctttgaactattttacttcaaactttacacataactgacctgtttataaatttctacaaaatatatctctaatgaatatgtctctgttagtatgaaaaatagaaactgtggctttaaagaaataatacaatatccattttaaattttttcagggattttaagatttaagtttacttatttgttgatgttcttttaacttgtaaagggtggtaatagaatgtaaacccagtcatgggactagtttttttttttttcttgagacggagtcttgctctgtcacctaggctggagtgcagtggcgcaatctcggctcactgcaacctccgcctcccaggttcaagcgattcttctgcctcagcctcccaagtagctgggagtacaggtacatgccaccacgcccggctaacttttgtatttttagtagagatggggtttcaccatattggccaggctggtctcaaactcccgcctgccctggcctcccaaagtgctgggattacaggcgtgagccaccacgcccggcccataggagtatttttctccacaatcctaggattttaacttggcccagttccctagatttctaagccctaggttttgttgctgttgtttttaaaaggattgaattggcactttagtgtgttttggaaaatttggctaatggtatatgggagtttgtagttgctaaacatcaaagaatataaaaagatttccagatggcattatcatttacatggcataagatatggagaatcgttagatttaggaatcagtttcagaacatgccattggaaaatttatgttaaaagactggctaactataacaataaatgttgttaagtgccattattaagggaatgaaagggcatatgttagtacatctcacaagacttatcaaaatattgatattttgattattatgtttttgggcagattttcaaggcataacactcagaagtttactgcttcttcacatatatttatatatttttgagactttagccagctttcctttccccttttcattttctagttagataaaaatctattgagttttctcttctttctttttcaaatatattactgtccataattttgtttcattccaaggagttatttcatgacattttggtttaaatgttgtcttcccagttatatcttcaacaagtgaagtttgtcttccattttataaattactttttcatacaaatatctcttgttgctttgaattttaaaagtaatttgatcagaatgaatatgctaatcaggtttttgagcagcaatttaatagattttataaattttaatatctctaaaattgaatgtttgaaaatttctatgaattctaaattttctcataataaattctaatgaattataaatattctattgactatgttaaaattttattgcaacaaatttctgagttctatttatgtcaggcactgttgtaagcactagggagaaagcagtgaagaaaacaaaattctgtggccccgtggagttttcattctgttgtgggggtgcaaaccaaaagtaaaaaagtaaatggcaagcaaagacttcaggcgataccacggatgtctcctggtgccagctggaactgctgggtaaaggactgacagattgtaccatctgccatttaggtccaggagaggatgattggtccagacacaattgaacatactggattatcctcttggaaagagaccattctgctgctgtccacacaaattgaacttcagaggacgcccaactgtaacaatgggggcttttgcagctatgagaatggctgctaatgaaaaatatcttgcaactagacaccagctgtggtgatagcacttagagaccttatgagaattgaaggttgtgcactgcttcttgcgctgaagattctgaaaccattggtcccagcccgctcttgcagttatctcagagagctctatcatggcgtcattcagtggaccaatttgtctctcttcagtctggccctcaacccaggaggctaattaaacacaaacctttccatcagtgacatgaattaatgggtatatctatatgaaaaattagaagaaagagaggattgttcattcattgacctctttcacaaacttcctgggtttggacgtgtttattcctaaccaatcagggtttgtcacctccctgtgggatgaaccgaattgtctctcctttccctctagtaatacactttataagtactcaagagccactattctgtcattgcaagaagctttcagggacagaggaatgattgtagaatcactcagtgcaaagttaatgaacacattcttacctatccaggttgattagagatagcagtagtgacaatgagcaaaactaactatcttagtcccttcaggctgccataacggaataccatgtactggctggcttataagcaaaataaatttatttcttacagctctggaggctgggaagtccaacatcaaggtactgcaaatttggtgtttggtgaggggtctgcttccttatttgtagacagtggtcttcttgctgtgtcctcacatggcagaaggggtgaaaagctctctgaggtaccttttataagggtaataatcctatacatgaggggtctgctctcatgacctaatcacctcccaaaggcccttcttcctatgccatcgccttgggggtgaggatttcaatgtgaattttgggggactcaaatgttcagaccataacaccaactatcatatcatattggtgtacttatcctggacccagaggaacagcagtcatagtctagataaagaagtctcttgggcttcagtgtctccaatcagatgcctctccagagggactccttatcccaatctaccacatcattttcttaatgactacgggagctgctctgatattactttgtcttgtattaatgccagcaaatatcttaggtccattatggtttatgcatcaatgcataatttctatttagttttcatgtttttgagcttcatagcttgttattatcatttgttttatacaatcaatgttcatgtaaacaggtaacataggtataataatagggttgtaatggatatactgaggctttagacaggaggaagcatttgaggtaagacataaagggcagagaaacagggaagaatatcttgaccatgtgccatggaagaataaaagggtgtggtatgtatggacaatggtgagaagttttgtatgcctaggagtacataagaatcaaaggctacaacttgggagaggaatgttgaaacaggtaactcagaatcatataaggcatttcctgacctattttaaaggtggaatcacagcaggtcacaggtgacttactcacattcataattttaaaatctcttctaataatgactttttatttttatatgtactgacattgataataatgattatatcttctttcatttttgtgtctttaagtagtttccttccattcatcatctgattttatcctaattatctctgagtggcacagctctgaaatattatagtattctaatttctacagatagggaaactgagatatggagagcttacatggtttactcacagccacatggccatgcttccagtgacgcagacttcggatttttaattgcatatacttgtcagattttatatgtatgctttttgtctattttcctctcaaatactgttgtgtgtgtgtgtgtgttttttctctataggacttggcctttaccctggaagagagacagcaattgaacattcatggattgttgccaccttccttcaacagtcaggagatccaggttcttagagtagtaaaaaatttcgagcatctgaactctgactttgacaggtaacacattgctgaaggtggtttttatatttctcttatgcagttgtctagtttattttttattgggtgagaaaatgaaaacatttaatgatttggaaagggtagccaactttgagaagaattttcctgtaaacacaatgatgtttttaaaaaatttactctctttaggaacatttgaatgaaataaaattttgctttctaaactgcgtgctcagacagaccatgtttatcatatgatactgcaaaagcaaatgatcaggaaatgccatcctgaacagaataaaacaggttagagtggcttttagtcacactttaagtatattgtagttgaaagcacacttttctagcctccagtctctgttccaacacagttgcaagtttaggtcacttactttggatagtgtattcagtttctgtatttgcacaaagataaatataatatttttccctacctttgggtttagataaccttagattgaaattcaggctctatctcactagcagtagatccttgagcaaccactacaggccctgccatggcgactgtaactgctttgctgtctgtttttgactccactctttcttactaaggtactaagcctttgtagaccttagtttttttcatccatggattagagagaacaacagctatttgaaaagattgttgtgagggttaaaagaggtagccaactcaatatcaaataagtgttggtgttaatcagggtgttactcagggttctccgaagaagcagagctgataggatgtgtgtgtgtgtgtgtgtgtgtgtgtgtgtgtatgaatgaaaatataaatataaatggatagagggagaaagaaggagagggagaaggcttgttaaatccaaaatcttcaggtaggttgtcaggctgaagactgaaggaagagttgcagttgagtccaaaggcagtgtgctggcaaaatttatttttgctagacaggaggtctgtctgtgctattaaggccttcagccatttggaggaggcccacccatattttggagggtaatctgatttatttaagtccaccaatttagatgttaatctcatccaaaaacacctgtgcagaaacatccagaatagtgtttgaccaaatgttgatacaccatgtttgctatggattgaatgtttgtgtccccctgcaaattcgtacgttgaaatctaatccccagtgtgatgttatttggaggtgaggactttgggtgatgattaggtcgtaaaaatggcaccctcatgaaatgggattagtactctaaaaagaagaggccagagtaccaacgaaaaaaacccaggatcagatggattcacagctgaattctaccagaaatataaagaggagctggtaccattccttctgaaactattccaaacaatcgaaaaggagggactcctccctaactcattttatgaagccagcatcatcctgatagcaaaattgggaagagacacaacaaaaaaagaaaacatcaggctaatatccctgatgaacatcgatgtgaaaatcctcaataaaatacttgcaaaccgaatccagcagcacatcaaaaaacttatccaccgcaatcaagttggcttcatccctgggatgcaaggctggttcgacatatgcaaatcaataaacgtaatccatcacataaaaagaaccaatgacaaaactcacatgattatttcaatagatgcagaaaaggcctttgacaaaattaaacatcgcttcatgttaaaaactcttggccgggtgcggtggctcacgcctgtaatcccagcactttgggaggccgaggtgggcggatcacgagttcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaacaacaacaacaacaaaaaaaactctcaataaactaggtactgatgggacatatctcaaaatagtaagagctgtttatgacaaacccacagccaatatcatactgagtgggcgaaagctggaagcactccctttgaaaaccggtacaagacaaggatgccctctctcactactcctattcagcatggtattggaagttctggctaggtcaatcaggcaagagaaagaaataaagcatattcaaataggaagagaggaagtcaaatagtctgtttgcagatgacatgattttatatttagaaaaccccatcctctcatccccaaaactccttgaactgataagcaacttcagcaaagtctcaggatatcaaatcaatgtgcaaaagtcacaagtattccttcacaccaaagatagacaagcagagagccaaatcatgaatgaactcgcattcacaattgctacaaagagaataaaatacccgggaatacaactaacaagggatgtgaaggacctcttcaaggagaactacaaaccattgctcaaggaaataagagaggacacaaacaaatggaagaacatttcatgctcatggataggaagaatcaatattgtgaaaatggccatactgcccaaagtaatttataattcaatgttatacccatcaagctaccattgacttttttcacagaattagaaaaaactactttaaatttcatatggaaccaaagaagagcctgcatagccaagaaaattgtaagcaaaaagaacaaagctggaagcatcatgctacctgacttcaaactatactacaaggcaacagtaagcaaaacaacatggtactggtaccaaaacaggtatatagaccaatggaacagaacagaggcctcagaaataacaccacacatctacaaccatctgatctttgataaacctgacaaaaacaagcaatggagaaaggattccctatttaatatatggtgttgggaaaactggctagtcatatgcagaaaactgaaactggaccccttccttacagcttatacaaaaattaactcaagatggattaacgatttaaacgtaagacctaaaaccataaaaaccctggaagaaaacctaggcaatacattcaggacataggcatgggcaaagacttcatgactaaaacaccaaaagcagtggcaacaaaagccaaaattcacaaatgggatctaattgaaccaaagagcttagagcttctgcacagcaaaagaaactatcatcggagtgaacaggcaccctatagaattggagaaaatttttgcaatctgtcaatctgacaaaaggctaatatccagaatctacaaagaacttaaacaaatttacaagaaaaaaacaactccatcaaaaagtgggcaaaggatatgaacggacacttctcaaaagaagacatttatgcggccaaaaatcatgaaaaaaaactcatcatcactggtcattagagaaatgcaaatcaaaaccgcaatgaaataccatctgacaccacttagaatggcgatcattaaaaaaatcaggaaacaacagatgctggtgaggctgtagagaaataggaatgcttttacattgttggtgggagtgtaaattagttcaaccattgtggaagacagtgtggcgattcctcaaggatctagaaccagaaacaccatttgaccccacaataccattactggttatatacccaaagaattatagatcattctactataaagacacatgcacacgtatgtttactgcggcactattcacaatagcaaagacatggaaccaacccaaatgcccatcaatgatagactgactggatgaaggaaatgtggcacatatacaccatagaatgctatgcagccattaaaaagaatgagttaatgtcctttgcagggacatcgataagctggaaaccatcatcctcagcaaactgacataggaacagaaaactaaacaccacatgttctcactcataagtgggaattgaacaatgagaacacatggacacggggaggggaacatcacacaccagggcctgtcgtggggtggaggaaaggagagggagagcattcggataaatacctaatgcatgcagggcttaaaacctagatgacagtctataggtgcagcaaaccaccatggcacatgtatacctatgtaacaaacctcacattctgcacatgtatcccagaacttaaagtaaaataaaaaataaaaaaataaaagaggcctaagaaagctgcctttccctttccctcatgtgaggatgcagcgagaatgtgctgtctatgtggaatgtgtccttatcaggctcagaatctgctggcagcttgaccttgaacttcctggcctacaaaactatgagaaatcaatttctgttgttcataagctacctagtctatggtatttttgtcatagcaaactgaatggactatgacaccacccatatgaatctcctcaaatcatacttaatctttgaataaaggcaataacaagatccatacttccacctaacacaataaactatcttgcatacaaccaaaaatgcaccaaccctatcctcaaaagaagatgccaaatccttgggtgatgtttactctcgtcgatattccttaacttaaacactatgatgtaatgttagcagtacttaaatactatgatgcagagtcagtatatcttatgttatcagataaggtgataagagaaggaagaaaatgatattttctgaaatttgcatatggattgttgcttttatatgtatacacacatattaatagcaaaacaaggaagaaatacttatggcaattacagtcttctttttctttaattgatcacatggtcatagctggtgtttataactacctttttccatgacccaatccatatcccctttgccctcagcaagtatctcagctgattgtggttctttacctggtgagggtgactcaaaccttcaatcctcaatggtctgggccactagtaatcctgcttgaattggattgttgttttcattagctttaatcacagggcatggtaatactaagagctaccctaaggggtctcctgtatttcagacatactctttcccgcctccactgtagtgtaacagtttagtttcctcttggtagtcaggatcaatttttcccagtcagcacagtaactcctttcttggcctgttaattcagaggcatgtggtgctcaaagtggtcaggtggcagtcttaatttcctgttcaatgggtttattattgtgtttcttgatggaaacattcttccgtttggaatgaagacctctagaccagcagagcataaagtcacaggggtagaaaggagaaattttgctagtgtgacactagggttgttagtgagaggtgccatttccatttccaccccttgattcctagacctatgaatcctggctatgagaaaaacagcaccatttttttggacactgattgagagcacatacagcctcctggagaaccttgcctcagctttgcaaggtattggcactttgctggtaactgagtcttcaaaagtacattccactgttctgtcaagccagttgcttcagattgttgggaaacattgtaaaactagtgagtttcatgagcatgtgctcattccccacacttcgtttgctctaaagtgagttccttgatcagaagcaatgctgtgtggaataccatgagggtaggtaaggcattttgtaagtccatgaatagtagctttggcaggagcattgcatgcagggaaagcatatctagatccaaactaagggtctatgccagaaaaaaaagttgtccttcccataatggaagctgttgagtgtaatgaacttgccaccaggtagctagctggctaattaccctggagaatggtgccacatcagggaatcagtgttagtctctgctgcagattgaacactcagaagtggctataatagccaggttggccttggtgagtgaaagtccatattgctgagcctatgcataacctctatccctgccaccatggccactttgttcatgagcccagtggatgtgatggggtggctgggcaaaaaggctgactcagtttgtccgacgtgtatacagttgcttctttttaaactccttcgcaaccttctctttcatttgttccataacatcttcctttagctgcttgtgtccttactttatattcttttcctgggccattttatcagctacctgctaagagctggtgaccttcatatatttgctacagactgttcctcgatatatattgaacatcaattcagtgtcaggtactcttttagatattggggttatagacaatgatctctgacctcatgaaatttacataaattattaaaaattattattattttgagaaagggtctcactctattgcccaggctgcagtgcactgacgtgaccatagctcactgtagtctcaacatcctgggctcaaacagttctcctgcctcacccttccaagtagctaggactacaggcatgctccaccatgcctggcttatttttaaatacaaattattaaattttgtaaatagtaatacaaattggtaaattataaaatatgctagaaaatggctagtgtcttgggatgggggaaataaaggtagagcagggtaaagaggagctgagaatgctgaggggagttatggccagtttgcattgttgagttgggtgataagggtaatctccattgagaaggtgagttttgagcaaataatcaaaggtggtggagcagttagccatgaagaaatctgaggaacagcgttttgtagctggcatgttcaagaatcagcagggagacttgtgtctagagcagaatgagttagggaaagaatggtaaattgggaaaggaagttagcgaggtaatgggcggttgattaggtatggctttgtagcctattaaagacttctgctatactatgaatggaaagggtagcctcttgaggtttttgaccagaagagccacatgatctaagctataatttcagaaagactggctgcaatgttgagaatagaatgtaggctgggatggcttttaggagaccattagaataatccagtcaagagatgatggtgatttagatctagggtggtagcaataaaggtggtcagattttggatatattttgaaagtaaagccaacacaatttattcatgtatttcacatgagtgttagaaagctttcagagaagaggagtatgttagtctgttcttgcattgctataaagaaatacctgaggctgggtaatttataaagaaaggagatttaaatggctcatggttcagcaggttgtacaaacatggcaccaattatctgctgccttggtgagggcctcaggaagcttacaatcatggtggaaacaggagcaagataggaaggaagtgccaaccaaatctcacatcaactcagagcaagaactcatcacaaagggattggtgctaagccattcatgagggatccacccccatgatccaaatacccaccaggacccaactccagcactggggattacatttcaacatgagatttggaagggacaaacacccaaaccatatcaaggagaaaacagcaaggaaacagaaaaggaatgaccagagagataggaggaaaaccatgagaatatgatagattggaagtcaatgaaagaaagtgtattgagccctgaggaatatctcctgtgtcaaatattctgataggtaagatgaggtctgagaatggaccattgatttagcaatgctaatttccacattgccaaattaattttatcatgtctaaagttaaactctttgtcttccacatgtttattttctgggttatgtctatctaattgcccaaacattggaatccatgcatctcttactcagaattctgtgcattttcaactattctagggaatgaaaatcaattcaaaatggctggtaagattgttgagtagttttgcaagattcttttaagttgaactgagcagtttacgttttattctataaactattgaaggttacagatatcatgaagaggtttatatttacaaagataactctgggtcagaaatgcttctagaaagaaaaaggccataagatacagatacaaagaaaagtttcttgaacttccctaccttagttatttttaggatgagtgttacattctcttacttatttcctgtatgtcatttcccttggttattcaatactgcaagtcaaaggatgaaatctttctattaacttagttaatactaaatctatagttatattttcatctcttttaaaatagggataaagtctcttcaagtattaaataaaactgtgctatttcagcagtgattttaatgtttgcatgatattagttaagtttatggttctttattctttgcaatatttaagagtatttcttgtctgggtgcggtggctcatgcctgtaatcccagcactttgggaggccaaggcaggcagagcacttgaggtcaggagttcaagaccagcctggccaacatggtgaaactgtctctactaaaaatacaaaaaaaattagccgggcttgttggtgcacgcctgtagtcccagctacttgggaggctgaggcaggagaaaacgcttgaacccaggagacagaggttgcagtgagccaagatcatgccactgcactccagcctgggcgacagagcgagactctgtctcaaaataaataaataaataaataaaataaaaaataagccgggtgtggtggcatgccctcgtaatcctagctactcaggagatggggtttcaccatgttggccaggctggtcttgaactcctgacctcgtgatccacccgcctctgcctcccaaagtgctgggattacaggcgtgagccaccatgcccggccacttttgtatttttagtagagacggagtttcaccatgttggccaggctggtcttgaactcctgatcttgtgatccgcccacctcagcctcccaaggtgctgggattacaggcatgaaccactgtgcccggccaagactctgtcgtaaagaaaaagaaaagaatatttcttaagtcttttttaatcagatgttttctatgtaacctaaatgtactttatacttggttgaaaatatttaattagatttctaagtagctatttcatgactttatgggatgtagatctaattatgtccaatttttacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaaggtatgtcaacttttattttatatgcaacttgtgtctttatttatttttgtaagttttttaacgaatttaaaatttattattattattttaaatttgacaataaaattgcatatatttatgatgtacagaggatgttctgaaacatgtatacattgtgaaatggtagaatcaagctaattagcatatgcattatttcacattcatatcatttatttgtggtgagtatgctaaaatctacttttagcagttttcacgtatataataaattatccttagcaatagtcactatgtggtacaatagatgtcttgaactcattcctcctgtttaactgaaattttgtatccttttaaccagcatttccctaatcccgcaacccgctccccctacctttctcctatcctctggtaactaccgttcttctctttgctactatgagtttgactatttttaggttccacatgtaagatcatgtggtatttgtctttctgtgtctggcttatttcacttaacgtaatatcctaaaggttcatctgtattgttgcaaatgacagaatttctttcttctttaaggctgagtggtatcctagtgtgtatgtgtaccacattttctttatccattcatctgttaatggactcttaccttgatcccatatcttggccattgtgaataatgctgtagtgaacatgggagtgagtgcagatatctcctagacatactgatttcatttcctttggatatgtacccagtagtgttattactagatcatttggtagttctattcttaattttttgagaagcttccatactgttttccataatagatttactagtttacattcccactgaacagtgaataagagtttcctttcctcaggttcctcgccaatacttattgttcatctttttggtatagccgttctaacaagtgtgaggtgatatctcactgtgcttttaatttcgatttctgtgatgattagtgatgttgagcaatttttcataaacctgtaggtcatttatatgtcctcttttgagaactgtgtattctggtattttgctcattttaagaacaggttatttgttttcttgttactgagttatttgagttccttatatattttgaattaatcccttatgagatgtatggttcacagatattctctcctattccataggttgtctcttcactctgttgactgactgctgtgctgagctttttagtttattataattccatttgtctatttttgcttttgcctatgccactggggtcatatctaaaaacatcattgcccaaactactatcatgaggcttttcccctaaattttcttgtagaagttttatagtttcaagtcttacatttttctttacctattgagttgattttttttaatatggtgtgaaataagggtctaatttcattcttctggcatttggaaaaccagttttcccgtcaccatttaatgaagagactgttctttctccatttcacttttgtaaaaaatcagttgactgcaaatgcatggatttatttctgggctgtctattctgtttcattctgggctgtctattctctttctttggtctctgtgtttgtttttatactggtaccatgccgttgtgattaccataacttaacagtatattttgaaatcaggtagtatgatacctctagctttgttctttttgcctaagattgctttggacatttggggccttttgtggttcatatgaattttttaatctttatttttatatttctgtgaaaaaatgtcattggaactctgatagggattgtactgaatctgtagatctctttgggtagtgtggtcattttaacaatattaattcttccaatccatgaaatggaacatctttccatttatttgtgtcttaaatttttttcatcaatgttttgtagttttccacatacagatatttcacctctttggttaaatttattcctaagtattttgttgttttggtggctatcattattattattattgttttgagacaatcttactttgtctggagtgtagtggcatgatcttggcacactgcaacctttgcctcctgggttcaagtgattctcatggctcagcctcctgagtagctgggattacaggtgcgcaccaccatacctggctaatttttgtatttttggtagagatggggtttcaccacattggctaggctggtctcaaactgttggcctcatgtgatccacccgcctcagcctcccaaaatgcctcccaaagtacaggcatgagccaccacacccaccctttgtagctattattaatgggattgcttttttgatatttttggatagtttatagttagtgtattagaaacactgctgacttttatatgttgattttgtatcatggaactttcctgaatttattagttgtaacagttttttgttggagtttatagggttttctatgtatatgatgatattgtctgcaaacagagaccatttaacttcttcctttctaatatggatgcctttttttttttcttttgcttgcctaattgttttggctaggacttccagtctctagatttctctctagatttaagatttggccaggcacagtggctcatacctgtaatcccagcactttgggaggctgaggcgggcagatcacgaggtcaagaggttgagaccatcctgaccaacatggtgaaaccccatctctactaaaaatacaaaaattagctgggcatggtggcatgtgcctgtagtcccagctactcaggaggctgaggaaggagaatcgcttgaatctgggaagtggaggttgcagtgagccgagatcacgccactgcactctagcctggtaacagagcgagactctgtctcaaaaaaaaaaaaaagaaaagatttaagataatagaaagtatttccaaatcaatttgggttcccttttacagatagcaaattaatttcctttttgttttgaaagagattggctgggcatggtagctcacacctgtaattccaggactttgggaggctgaggcaggcagatcacctgaggtcaggagtacgagaccagcctggccaacatggtgaaaccctatctctactaaaaatacaaaaattgctgagcgtggtggtagttgcctgtaatcccagctactagggaggctgaggtaggagaattgctggaatccaggaggcagaagcttcagtgagctgagattgctactgcactccagcctgggtgacagagtgagactccatctcaaaaaaaaaaaccaaaaaaacaaaaaagtaatactgatcataattaagcttgcctttgatatgttaattaccactattacatgtatatttttacaagttaaaacaaagattccaaatttttctgaaatgagaatattactttctaaattgagtcaaaattaaatgatcttaaagtagctcttttgttctttcccttaaatgaaatagtagtcacctttgagatgcataaaatatagaacacaatttttctagcactacttattcattatattagtttcaatactttttgaaagaagaaacaatcgaaataaatacatattaatacttttaacaacagcaataacaaaagttcaagttgcatatgtctttctacttttggctctgaatttaaagataaaaaagaaatgtttaaagtatctaccacaaacacaaaagcctactgaaagtactgtccttaaaaggaatatttcagaggtattatcggaaagcaatattgaatgtggatttccatgtagctgtattgatatagtggtaatatttatcatactgcgctgcattaccctttgtataaagaaaagagttggccgcatcatccctttgtataaagagaataattagataagtaactatagttgatctaaactacattaaaatttttttattgatacatattagatatacatattttggggatatgtgtgataatttaatacattcatataatttgtaaagatcaaatcagtgtaattgagatatctatcaccttaaatatttatcttttctttatgctagaaacattcggattatcttcttctagctgttctgaaatatacaataggtcttatttgttccatcaaacttcatactaaactacattaatagcacatatccatgttacatttatgtaatagttacattaacaatgactaaattttttttcattgaagaaaaggagttagaatttactgttaattgtattgcaaagtaattgttttctgggtatataagaatattattttaactatacaaataattatatattcattattgaaaaaataataaatattcagaaggaagaaacttaaaaatgcctaatgtcatcgtaccaaaaaacgccaacagacacaatacatactattttccttgtagatgaaggaatcatactacataaactatttcttgccttactaaaggcaagaaacctacagtattttccttatagatgaagggtcatactgtatgaactatttcttgccttactgtcttctctgggtaatgtattataaacatctgtgcatgtccaaaaaatatatttctatataaagaatcttaatacaagcataataaaaagctgttttaaattcaaggatgtttattgaaattttgtttctgagagatactaagtactaacaatgataaatgtagaagggcttgaatcaaacgaagtatttgagttgaagtcgatagaaatctcaatagcaacaagtttttttttttttggcaagcacaggggattttattgatggtacatgaaaaggtggggctccctcggctcctcccttttagggggtctgcatggaaactatgaggaggggagattctcagtgtggtgggagactgagtgtggcagggactctccagcagtgagggccgctctcttcccgtcgtgctgtcgctggggctggtggtctgggggtcttactccttggaagccacactgtgggcagaggtccaccaccctgttgctgcagccaaattcattgtcataccaggaaatgagcttgacaaagtggtcgttgagggcaatgccagccccagcatcgaaggtggaagagtgggtgtctgttgaagttggaggagaccacctggtgctcagagtagcccaggatgcctttgagggggtcctctgacgcctgcttcaccaccttcttggtgtcatcatatttggtaggtttttccagacggcaggtcaggtccaccactgacatgttggcagtggggacacggaaggccatgccagtgagcttcccgtttagctcagggatgaccttcctcacagccttggcagcaccagtagaggcagagaggatgttctggagagccccatggccgtcaccccacagtttcccataggagccatccatagtcttctgggtggcagcgatggtcatgagtccttccacggtaccaaagttgtcatggatgaccttggccaggggcgttaagcagctggtggtgcaggaggcattgctgataatcttgagctgttgtcatatttctcatggttcacacccatcacgaacatgggggcatcagcagagggtgcagagatgatgaccgttttggctcctccctccaagtgagccccagccttctccatggtggtgaagatgctggtgaactccatgatgtactcagtgccagcattgccccatttgattttggtgagatcttgcccctggaaaatagtgatgagatttccattgataacaagcttcccgttctcagccttgacggtgccgtggaatttgccatgggcggaattatactggaacatgtagacagtgttgttgaggtcaatgaaggggtcattgatggcgacaatatcgacttaaccagagtttaaagcagccctggtgaccaggcagccaatacaaccaaatctgttgactccagccttcaccttcaccatggtgtctcagggatgcagctggcaatgcacgagaagatgcagctgttgttctcagccttgacggtgccatggaatttgccatgggcagaattatactggaacatgtagacagtgttgttgaggtcaatgaaggggtcattgatggcgacaatatcgacttaaccagagtttaaagcagccctggtgaccaggcagccaatacaaccaaatctgttgactccagccttcaccttcaccatggtgtctcagggatgcagctggcaatgcacgagaagatgcagctgtctgttgaatgggaggagcagagagctgcaacaattattttttgagagcttttactatattagatggttttctcaggcttaggacactttggtgtgcatatattccaaaagaagaagagacaaacatataaaataaataaattgtctagaatgtttgaaggtgataagtgttatggagaaagagaacaggaaaagggggatcaggagtgtcagttgctttgcaggaggcagttgtaattttaaacagagtggacactgtgggtctcattggaagatgatattggaggagttggggaggaagtcatgtagatatgagtggaaacatgccagacagaaggaacagccaatgccaaggccctcagtgggaacatgcctggagaccagaagcaggatggagaccactgtgtctggagtggagtgagagagagggagagtaggggatgagttcacagaggtgggtcaatgagtgggtatatgtcttagggcttcctgtaggctgtttggaagaacattggcttttactcttagctaaatgaaaagccctaaatggtcttacgcagttacatgacatgatctagtatttttaaaaagagcattctggttgctgtgttgagaatagactaaagcaaaagaagaatcagggacccttgttaggagactattaaaataaacccagtgagagatgatagtggttcagattaggagggtaataatggagttaggggtaagttttaaaatccagattctggataaaaatgaagacagccacaaagaccttctgctggactgaaagcttcctagagtagtgattgaaagtatgggctctggagtaggtagcctatttttacttactggttttgccacttgttgtagtctggtataaggtatttaacttttctgtgcttcggtttcctcatctgtaaattgggagtaatactacagcctgccgcatcttatccatacttttgaattccaaaactttgaaaatcaagactgtaaaaaaatctcatttgggacaaaacctgatcttatctgaaatcattggcagcagtaccaaagactatatatagtcttataagtccagcagtaaactggatttataagactataatagtctatttatttcacttactgtcatttgtttttctgtagaagtactaatgtatttgattatgggaactttcttagaaataaatatgtttacatatatataaacttatataagtatgtgtttttatgtatgtatatatgtatatatatagagagagatgggtggctggggagggggagaggaagaaatggggaagagggtagaggtaggaaagcatttgtggcaaaatgcttacaaatgttgaatctaggtggaggtatttgttgtattattctttcaacttttctgtaatatttgaaatttaagtaaggaatgctttactgctagagaaagcaaagtttctaaatccatttctgtatgatctcttcatgacagttttctgtcatattgcaatttagtgtgtatattttcttgaacttttgatgattttgaagttttccagtaaaataattatggcttctcctataattataaaaaaatcctgtttgaaattgtgttatgtggcttaaatttaggtgttgtatttaattagaaagggaattgtggatgcgtgaatgatgtgaatgatggatcttccattagcatatagatgaattttatttttaagccaaaatggaaaagtgtctagtaaaccttatctactacaacagcaggtattttaagacattcagaaagtgaagaggagaattataccccttattctattaatacttactgtgtatggttttggtggtagcacttaggaacatagtgaaaattaagggttaaaagtacttcaagtactgagcttaacatagttacaaacaaatatatcttttgatcatacttttaagtatgtatcttaatgctgtgatacttttctgtggctagatttttttattttgaatatggcattaaaatctggctaggtatcccaaaataaattcttgtatgaataaccgtatttctaatttttttctaaatgactgctgggatactcctttattggttttgtgtggaatttcttttctttttggcatagatactttatgtgggtttttcagatgtcatagataatcatttttaagaatatttttgggctcgcttggattgtcttattcccatgtgccgaaatcattttaattcttgcagaatttccagtatttggtagtgcaatctgcttatgtcagtgtgcctaattgtggttagtttgtacatagaggtgtgatttttggaagctagagacaatttttttttttatttttgcagactgctgagcttcctgtgttacttaagttacctgtattttgtgaaacttttttttaaagaaaagttttctgcaaattgataatgcaggtatatgtaatggatagctgaagcagattcatataacttctttggaaatatttctacctactgtatttttacactgcattttctaagatttatctccctctcttttgagttctgattagctacatattattataccatgtatttggcaattattcatgttcctacttttgatatttctaatgttctatcaaaatatgcttgatctgtttttttggtattttaccattcattttgtctcaactatattgtaagtaaaattctagagaaaagggatcatattttataaattattcttgtatttctcatgctatttagatttaatgcctggttggtgttcaattagtatatgttgtttgctatctcagagaaattgtaacttagaattactttattcattcactcacacagaaaaaatataaagtattcatataatctttatttctcctactgtttaagtgtattatgctaacaggcaaattctcataaataatagatattaaagaaattggacacactaaggaatcagactgtgaggacatgaaatattattattattattttacttttgagacagagtctcactctgtcacccaggctagagtgtagtggcataatctctgctcactgcaacctctgtctcccggattcaagtgattctcctgcctcagcctcccaagtagctaggattacaggcatgcaccaccatgcccagctatttttttgtatttttttagtagagctggggtttcaccatgttgcccaggctggtctcaaacttctgggctcaagagatccatccatcttggcctcccaaagtgctgggattaccaccgcatctggcctcattcactcatccttatacagggcaccactgatttgattttggcaaacagaatgagctaatacaacagtttgctggtgatagtctttttaaaagaagcattttccaaagtttgattagatagtacttttggttcaccaaaaagttatgatgaaaaaagtattcagtgctcgaattaactggagaaaaacagaattaaatgaaatcaaaaaagattctttacagccaagtttcttagaataataacctattttgtgagtcttttgaatggtgagaattagatttaataaagtagtatacatagcctaattcttggcacaaagtagatattctcaaatggtggttattgttactggtataattttaactctcaggtttcttgatcaaatagattgtggtatcatgtaccaaatttcagaatattggaatatttgagagagatagaaagttcatttggggggccagatgtggtggtgcatgcctgtaatcccagtactttggggggccaaggcagacggatcagtttagtttaagagttcaagaccagcctgggcaacatggtgaaaccccgtctttacagaaaatacaaaaatcaactggtgtggtggtgcgtgctatagtcccacctactcagggggctgaggtgggaggattgcttgagcctgggatgttgaggatgcagtgagctgtaattacaccactgcactctttctagcctgtgggacagagtgagatcctgtccaaaaaaaaaaaggaaggaaggaaggaaagaaggaagaaaggaaagaaaaagaaaagaaagtttatttttgggacatgctaaattttaaatgtgtttcggacttccaagtagaagggtctaatagtcaattaaatatatggatctggaacttggtagatgatgtagttaaaatgtcctaacattttaacttgcatattaatattatatgtgctgcacgaatggtatctgttttgattttggcaatgtcacagattatcaacaaaagtaattgttaaaaagaattagtcaataagttgttccattatgttgctttatgtcttcctagaaaattctttgaaaaatgcataaaaggaaatattaaaatcagccaaaacaaaatattaaaatatttttcctacatttaataatgcatttttatacttatttcctttagaatcccaaaaggatttgaagtagagtattcattatttaaattgtggggactaagctttctttattacttaatatgtaatttcatgtgaggaagtatgtctagtatgccatcatgaccacgattagaaatggagatgtatacaaacatgagggtctaaataatgtttacttatatggaaacatatagtttctgcagatgtatagcccatagtgttgtcttatatgatgagggtgtcagttttaattgatgtttaatttgtgaaatagcagcaagaaaagaagcttaaaaagaataaatgtaaaaagaaaccttcccaaagctaatactcctttaaccaaaaatgttctcgttgtatagtacagattataattatactatcaaaggagaggttaatataatgaaactttcatattgttcttgctttataaattttctctagttttaaatctacctggcttttttcatgtatctattttaattatatactgtatggtatggtaattttgcttgattaagctataagtacttcaataactcagtgattgtaaaatgagcctaagttgtttatggaaaagaaacatggtttcacagccagttttaataactgcaaattaaatttttaatgcttgaaataagactgtggcactgtcttagtcaatttgggctgctatgataaactaccataaactgggtactttatcagtgacagaaattcatttctcacagttctggggaggctgggaagtctgagagcagggtgtcagcgtggttgctttccagtaaggaccctcttctgggttgtagactgccagcttcctgttatttcctcacgttgcagaaagcagagagctctctggggtcccttttataaagggcactaatcatatggcctaaatcacctcccaaaggccccatctcctaataccatcatattgggggtcaggatttcaaaatacatgaattttgggggacacattcagtctgttgcaggaactttcaatagtttaatgctattctacttgttatttgacaattataatgtaaactgtcagttgattcagtgcccagaggttagtagacatgccttgctgtcctaggtcctctcactctgagatgtgtggagctagccttttttcatggaccagaatgggagtttctgggaaggggtgagaggcagtcctaaacctttaggtagtcctggatactagagctgcccaggtgaaccagaactatttttaattggatttgccttttttaaattaaactactttagaatccttaggaatatctaggaaacttttgaaaaccagggaatatttttggcttatagttctggtttagcatgtgacttttattttttattttgttataattgtctgtatttctagaaattctcttaaacatcaaatagttgatgtttaagagggcaactagcttttaatgcttccagaaaagtgatcattttaatgttaaatattaaaaacattttcactatttatctatggtaataagcctttgattttgatttatacttattctgtaatattatttggtccatttatttcatttcccttgaaactggcttacccctactttaaggtatgagaaaaagaaatacatggtgtaatttttttcaaagatatgaaacaagtcagatggaatgtctggactaattcaagtcttaactgttacctcagttgattttgtagttaaagataattatttattaaaagtggatttttatttattatagagatatagatgatgatttcttaaattatgaatttaaactaattattttttccaagcagaataaaagttatttttatgaaaatgtatatatgacttgtgctaaataggagtgaggtagagtattctatatcttaagtactggaaattcagtgagtgcccagaagtagtttaaaataccaaactgtcttctttcctaagcattgccttaatgaggaaaaatttggagaatggaaaaaatgtagacatgtttctaacatcagttctttacatcaagatctaagggttgtctaaatttgtgcgtagacgtataaatcttcaaggcagtgaaacttatcttttactgtaaaatgccattaaaaatataaagtaacagttcatcggctctccatattcatctagagattttaaatgtggaaaacttgaatggaaatttagtttaggatccaaaaataacttttgtacaatctgtgtggtacgttcaggtgttttgacttaagtttacacatagcatatggagaattaagaaaaattgccaagttttatctcaggtggtatttatggcagtctattaatttgggcattatttcctcatctttaaaaagagtatttgtttttaaggaagattataaatctcactgttctttactaaaaataaagaatttttaaaaaggaggcatagttcttatatcactttgcatcctctacccaaatcacatctcgaatattgtatttagttttgcataccatggttttgaagtgtcattgatatccagagaaagtgacaataacagtgacagttactgaaaacttgtcatgtgagaaacagttggtggaaataggaatgtttagcttaaaaggaaagacttgatagttaagccttcaattatttgaaagatgttcatatagaagaaagtgtatgcttgcatggcatagcctcagaatgtagaacttaatcactagatgaggtgtaaagccacatacccacaaccaggtcatctttgacaaagtcaacaataacaaacaatggagaaaggactccctattcaataaatggtgctaggataactggctagcaacatgtagaatattgaaacagaatcccttcctttcacaattaactcaagatagattaaaggcttaaatgtaaaacctaaaactataaaacactagaagaaaacttaagaaataccattctggacattggccttggcaaataatttatgactaagttcccaaaagcaactgcaacaaaaacgaaaaaaggaccctaattaaagagcttctgcacagcaaaagaaactattaaaagaataaacagacaacctacagattgggagaaaatattcacaaactatgcatctgacaaagctctaatatccagaatctattaatataaggaacttaaatttacaagcaaaaaccaaacaatcccattaaaaagtgggcaaaaaacagacacttctcaaaagaagacatgaaaaactgttcaacatcagtaatcatcagagaagtgcaaatcaaaaccacagtgagataccatctcacaccagtcacaatgactattattaaaaagttaaaaaaaatcagatgttggtgaggttacaaagaaaagaaatgctcgtacactgctggtgggaatgtaaattattttagccactgtagaaagcagtttggagatttctcaaataactgaaaactgaactaccattcaacccagcaatcccattattgggtatatacccaaaggaaaataaaccattcgaccaaaaagacacatgcactggtatgttcgttgtagcattattcacaatagcaaagacatggaatcaacctagatgcccaccagcagtggattggataaagaaaatgtggtgcgtatacacatagaatactacacagccataaaaagaatgaaatcatgtactttgcagcaacatgggtgcagcaaattgtcaattttaactcaatactatatgttttattgtatattttgtaataatattttatctttgctatggtaaaatttataaaatagttgatagaaggattccaaattaaatgttatctacttaaatccttaaggatatcaaattttatttttttctaagcaaagaagtttctcatttaacagtataaaccctgatcttaatatgattggtggctgaattaatggcatttataataatttggagaatatcatattttacaaaaatagtgctgccttgtgaaataaaacattttcactatgaaatgaggtaatttattttaaaagctgaaaatgtgcaagtatattatttccctctttaaataagttcatttttattgtcaacgtgccaaataaatgccatctgcctgatgagatcagtgttaccttaggattctttccagtgctttttaccatgaaaagtactttggagtttatcagaacaacagtctatttatacttaattaattgggtgcttgtactagttttaaagtgaataaatgaagaagaggttatataaaattattttctgtacattttgagtccacatttatttggaaacaatagttgagctgtgatatgtagagattgagtcagtaacatttgctatttgttgatttttaaaacctgctcattttataatgtaaaacaatcattcagaggaaagtatcaccagatagtaagtgccagagttggggcttgaacttgttttcttcctcctaatactttgcattagtaagagtcctccagagaaaaaaaaccaatagtatatatgtgtgtgtgtatgtatgtatgtatatgtgtgtatatgtatgtgtgtatacattttaaggagttgtcccatgaggctcgcaagtctaaaatctgcagtttgagtctgaagacagtctgctggcagaatttcctctttttcgggggaggtcagtcttttttaataagatttcagctgactggatgaggcccatacacattgtggaaggtaatctgttttattcagaatctactgatttaaatattagtatcatctaaaaactaccttcatggaaacatttagaatgtttgaccaaacatctgggtactatgcctagctaggttgacacatgaaaatagccaatacatattcctagaccaatcttgagtcttcttatcttagattgattatgttttccaactctactctgagttgctcagagaagcagcactcttatcatgtagctccttggacctttccctattgattaatatgtgttctgattttcaaaaggtaaaatgatgtattatgtttgttaattaagattattttctcaaatactggagtgtttacttgtgaagagtttcatatattgcttttcagaggagcttaattctagcagatatttcttaggaatattgctctactatggtttcacttttaaaagttcctaatactgactggattaattatagtaatttaacatttaaacctaattttagaaattgtcagataatattattgaccattcaattcttccggaagattcttgctttttcttcccaaccttgccatttctttacagtcttttaaattattgactatgcttattatttcccttctccttccttcctttaccagaaatttattgagcgtccactgcatgccaggcactttaccaagcattgagaataggtaaataaagacttaatttctgcatttgtggaatttacaggtaatattcaagtgaacaaagaaatacatgagtactgtttgtgttatgaaggaaatgaacagaggacaatgataaacaataacaggggatttcctttcacagtatagttagggaagtgcctgtaaggagatagtttaggctgccgcttgaaggataaggaagcagcttgtgaaaatcagggaaaaaaaaaaggaaaaaataaaaacctttgagcctgaggggatagcttgttcaaaagatctgggactggggaggtggcatgagatgaagtttgaggtagacagcagtctcatgcagggtgtgtgggtcatgatagagtttcattataaagcttaatccatttaaaaagccattgaatattcaaagtagacagcatctaactaaagttttaaaagattactctggctgccatgtggataaaatattagaaatgagagctagaatggaatggaaagggcactaagaagacttgcagtattggatccctttccaattcttaattgctttgaatgcacttgatcctcttaagatatggagcaaggaaatcaagaaaagctgtaagctaacagagttgccaatagcagcaaccagttcacatgggaataattccacagtcttgtagtcctgtactgatggctataggtaggtgaggtgatagggatatggacacacagcatgtaggtatatacacagactctaaatacatcagctggagataagaaggtctcctgtacataagactttctcaagcttgcagtaagctgagattgcaccactgcactccagcctgggcaacagagcgagactccgtctcaaaaaaaaaaaaaaagaatttcttaagcttgcaggcttaatatagttcattttatttatagcccaagtcaatcacctcactatcttgtcctttactcactgtacaaatccatcctgaaccaatcctttcttgccctcccagaagagccaattagatcatgttctatgaagccagtaagtattgttcatttcatttctgtgcacctattttttaattaaaatattattaatgtgggggtggagtgctataattctgcctgcacagttcaatttcggctgggccttctgctcctcagtgtttcattccagctgtgtttttggctcatctcactcttgcagttacaagaatgtaaacactctgcagccttatcctccttatctcagatatttctctccatgttccccatgaattcattggttcagctttttatttccatgaactatatctaatacatttcctttcttcaattatttccttcttaatctgttcagctaactgcagtgatccattccacccactaaaatgttggttcttgccaaggttttattctgggttctattttctttttattctatatattctcttagtcacatgtaattggagaatttccaagtcaatatttgtagcctagatttcttttcctaagattattactcgtattttcaactactaagtagctcatcttaatatggcaaacaactacttccacttacccactccccagcctaacatcccaggctcccaggttttctaacattgtaaggtgcaacatcattcattcagttactaaagcaaacacctcagagataatcaggattttttccccttcctttccctttttgagcattagaaattgtatcccttaattatctattgagtctcttttgtcctttcaatccccattgccacttttttttagctaggttcttcttgtttctttcctggactactactgcatatttacccttgaagactgtcaaaagggagtggattttcaaaaagatatatctaattatgtcattctcctgactaaaataactgaatggctccccatttcccccatgataaaattcaaactctttagcatgatattcaaggatttttgtaatttgacttctttgcctgcttctctgtcatctctttcctattcctcccactcatgtccctaccccaagttgaatgccctcgaaatcccctgggcattttcacaatctatttcatattgatggtgtagtaactgactttcttttctatctactgactgatttttttcttgagggtagcaactctgtatctttcagctatacccctgaacttagtagaattagcaatttttgttaagtgaataaatgggcaataaactatgacaaacattgccagccttgtatgtgctttggacctgaagagggttggtttgaatccctccatttcttcttactaaatgtctcatctgaactttagtttcctcttctgtaaaatgagtattgttactttgtttaagtaaaatgttccctcttaaacctttcttttgacaagaggtatatagaacttaaaaactgatttatctacaattcaaatgtacgtacagttctcaaatatcaaattctttcttataaagcagaagtttctacgtattgaaacttagtttgaaacgtgattacagaaattatcattggaacataattggtttaatgttataacatgtatttagtaatatataataatggaaaaggatggatgtcatctgactcatcaactaaaaaaataattttaagaactggatttcaaaaaaccaagcaaatgtaaattatgtattataaatatcattaatgaagatatttctaagacactaacaaatcaagattcatataaaaattactgaaaacggtgtttacaagcattcatagaatgcaaaggaagctattatgttattctgtctcacgactagtatatcatatttagtaccttaaaggaaatacaagtatttctgaagacaggtggaaagtgttaaatctaagtgataatttaaactatataaagtttctcaagaaagtcctcacccagaaaacaatctattttatattggggagttctttctttttcacatgagcagatgaggtcactaatttttctagtaagataaataagatactgatgttgtagatttctttttgcaaagattatttctttaccaaatttagcttgtgacttatcttgcagttataagacattcctaacatgtgactgttaaagtcttggagatggtagtatggtttctttattacttttcattatttctcatgcaacaaaatagagcagagtttattttaaaatgtgaaaagttacactaatgaaattcattttattagtgttgaaaataaggaagtaattagagcatttctataataaataagtaaccatcatgagcaatgccaaagaatatattgaactgttttcttcttgcttttatttggaaatgaggtacatgctagaaaacaatacaaaacaaaaacctcaagcaatcccagagggcagtcttctttagtttgtacccagagaaaaccactaatgactatggtaggaagaattccttgtggttggaaaacagatgaacaagttgctgaaagtctcatttatgtattaagccagttcagtcagtttgagagttacatgaaggatttctgttgtccaagtatctgctaactgccacattgaattggttaaaaaaaaaaaaaaaagaggaagaaagaaaaaaccttccctctcatgtcttctccaatcaatggacaaatataaatatctgaataaagaagataccttctagtttgatactttaacaatatagcaaactgtcttcggcaaagattatttctgactcattcaacctgatttacaggcatatgtaactttcattgtatctagtttttgtcagggtctatatgagaaaaaaataccaagtagagaaaattcttttatatctttcattgaaactgtggttagaaacaatgtctacaatgttgttcaatgtgctttatataaagacccatttgataaattcctctcaaaatcaaagaaatgcctttttttcttctttctctcttgctagaattgagaactaattcagtttttcctattgagctttgcctatatactattttatgctcaattatagtagttttctttagaacatctttttcctgtcttttccccacccccccattgtattaattatttttaatgaatgagtcttgcaaacacacattttagatagttgttagcccttgagttcctcctaggctcagtggagggctcgtgtcctttaaaaaaaataatctgacccactttagcagagtctcacactttcttcctcccctgggtatggggcaccttactgcagctcagagaaaacagagtaaatcttgcctgtcttctggatctctgtggttcctctcatttttctatggtttgaataatttcatgattttactgaatctgtgactttattaattattgcctcaaacctttttaaatttatttgaatccactagcaatttattttagtttaaatggaaaaaaaagatcacaaactaaaaccataatttgagtctttgttttttaaaaatactttctaaacaccaatccctttgccttcccagctatgaacatagttaattagcaagatcttggggaaatctgaaggctgagatcccaaaggcttcatatacattttttttcaaataattatttaccaacctagtacctctcccttttaaattaaattattatattatatatttgggagtttaaaagtttaagttattttgattgccagtatgctgccaaatattgggttaaatttaagtatttccaaaaactatgctctcaagtctgcaattgcatgtttgagagtgactggtaatttcatcaatgccagatgattatcattcctctttctgaaaagacatttttgatagaaagttgtttttttctttcttattactaaatgtcaaagagttttgtttagcagtgtcacttaattcttagaactgtttccaagtcatgtgccaaaaaacatgtagagatatattatggaaacttatttttaattgatgtgccagttgacaactagattatattctccttcaaaattgttgaaagcaaagaattagaagccacttgaatttcaaaaggatttgttaccccatcatcataatcatcactttttaaatttctgaaaactgtctccaaaagtctttaccaagatttttcaaatggtctaatatctgttattttttcacttaaagtcatttaatctgagatacttataaagggttgggaaaattaaaatattagttttgatacatttccacagtataaactttttcagtatgaaatgtgtgtatcttacacttttgtcataaacttgaagttacagatttcattccttgatgtattggaaaatacttgccatgtaacctcattggcccaaacagtcctctttatcaaatcttacaggtgaattagacttactttctgccagaaaaattctgacttcatttttcaatcaaaatgtgttaatatttcttttttgaattttttttttttttttgtgagacagggtctggttctgtcgcctgggctggagttcagtggtgcattctcagggcactgcagcctctgcctcccatgttcaggtgattctcctgcctcagtctcccaagaagctgggattataggcgtccgccaccacacccagctaatttttttttttttttgacagagatggagtttcgccacgttggccaggttggtctcggattcctggccttgggggatcagcccgccttggcctcccaaagtgctgggattacaggtgtgagctactgcacccggcctctttttttctttttttttttttttgacagagtttcactcttgttgcccaggctggagtgcaatggcacaatcttggctcaccacaacctccagctcccaggttcaagtgattctcctgcctcagtctcctaagtagctggaatcacaggcatgcgccaccacacctagctaattttgcattttagtagagatggggtttcaccatgttgcccaggctggtcttgaactcctgacctcaggcgattcacctacctcaggctcccaaagtgttggcatgagccatcgtgctcagccctggcctctttttttaaatattataaacaccactgagaaataatttatagaacacagcttatatgattaataaaaatcataatgtcaagattaacatgatgcagatataattaaatgatttatctatttaaaaattataaaacaagataattgtttctcatttgttaatttgtaataaagcagtataatatatagcagaaactacaagttatttatgaactagagagtatgaaacacttccaagtatgatattacttggaagtacgtatgtatgcatatattaagttctggtgttgggcatttagaaataacatacacaattcaattaatgtaatccattacataaacagaaacaatgacaaaaaccacatgattatttcaatagatgcagaaaaggcctttgataaaatgcaacatctcttcctgttaaaaactctcaacaaactaagtattgatggaacatatctcaaaataataagagccatttatgacacacccacagccattatcatactgaatgcacaaaagctggaagcattccctttgaaaactggcatgagacaaggatgcccactgtaaccactcctattcaacatagtattggaagttctggccagggcaatcaggaaagagaaagaaataaaaggtattcagataagaagagaggaagtcaaactgtctctgtttgcagatgacatgatcctatatctagaaaaccccaaggtctcagcccaaaagttccttaagctggtaagcaactgcagcaaagtctcaggataccaaatcaatgtgcaaaaatcacaagcattcctatacaccaacaatagacaagcagagagccaaatcatgaattaactcccattcacaattgctacaaagaataaaatacccgggaatacagctaacaagggatgcgaaggacctcttcaaggagaactacaaaccactgctcgaggagataagagaggacacaaacaaatggaaaaacattccatcctcatggataggaagaatcaatattgtgaaaatggccatactgcccaaagtaatttatagattcaatgctattcccatcaaactaccattgacattcttcacagaattagaaaaactactttaaatttcatatggaatcaaagaagaccccatatagccaaggcaatcccaagcaaaaagaatgaagccagaggcctcatgctacctgacttcaaactatgctacaaggctatggtaacaacaacagcatagtgctagtaccaaaacagacacatagaccaatggaacagaatagagacctcagaaataagaccacacatctctaactatctgatctttgacaaacctgacaaaaacaagcaatggggaaaggaattcctatttaataaatggtgctgggaaaactgggtacccatatgcagaaaactgaaactggaccccttccttataccttacacaaaaattatctcaagatggctgaaatacttaaatgtaaaaccaaaaaccatgaaaactctagaagaaaatctaggtaataccattcaggacataggcatgtgcaaagattttatgatgaaattgccaaaagcaattgcaacattgctaaaattgacaaatgggatctacttaaactaaagagcttctgcacagcaaaagaaactgtcatcagaatgaacaggcaacctccagaatgggagaaaatttttgcaatctaccatctgacaaaggtctaatatccagaatttacaagaaacttaaatttacaagaaaaaaacaaacaaccccatcaaaaagtgggcaaaggacgtgaacagacacttctcaaaggaagacatttatgtggccaacaaacatatgaaaaaagctcaacatcactgattgttagagaaatgcaaatcaaaaccacaataagaaactacctcacacctgtcagaatggtgattattaaaaagtcaagaaacaagagatgctggtgaggctgtggagaaataggaatgcttttacattgttcgtgggaatgtaaattagttcaaccattatggaagacagtgtggtgattcctccaaggtctagaaccagaaataccatttgacccagcaatcccttttctggatatatacctaaaggaatataaatcattctattataaagatacatgcacacatatgtttattgcagcactatggtcatcaatgacccaacccaaatggtcatcaatgatagactggataatgaaaatgtggtacatattacaccatggaatagtatgcagccataaaaacgaatgagataatggccttttcagggacatggatgaagctggaagccatcatcctcagcaaactaacacaggaacagaaaaccaaacaccgcatattctcatttataagtaggagttgaacaatgagaacacatggacacagggaggggaacaacacacaccagggcctgtggggggtgaggggaaggagatcaggacaaatagctagtgcatgcagggcttaatacctagatgacaggtcgatagatgcagcaagccaccgtggcacacatttacctatgtaacaaacctgcatgttctgtacacatgtatcccagatcctaaagtaaaataaaatttaaattaaaataaatttaacaaattaattttgttaaatataatgatcaaactttctatgtatttaatgaaagataaaaatacacattgctggctgggtgcggtggctcacgcctgtaatcccagcacttttggaggctgaggtgggcggagttcgagaccagcctggccagcaggtgaaaccccatctctactaaaaatacaaaattagctgggcttgttggcacctacctgtagtcccagctactggggaggctgaggcaggagcatcgcttaaacccgggaggtacgggttgcagtgagctgagatcgcaccactgcactccagcctgggcgatgaagtgagactcttcagaagaaaaaaaaacaaatacatgttactaaaaatgcttggtttggtggtctgtcaataatttggcctttggacaaagatacaggaaatatgaaacatttgataaaataaattaatatgagggttatttaacaggaataaatgctcgaatttaataaagtgttatctaatatctaactgaaggatggaacttttatttgaatgaaaataacatgaaatttttatctgcaggttttagccagtatatctgggaatatttagtagttttggaaagtattctatttatgttaaaacattcaacatcactaaacatttacttatttcagctgtttgaatatttctttctttccggtggacatagcataaccattgtgaatagctggaaatgtatgctttttgtcaaatatgtgagggaaaaagccattttcaacatatggttcttttgccttactttcatgagtgtctccctcaacagtgaagccatctcccactggtctactctacattgtctgaattcagaactaaaaataccctcattctagtgttagagtttacctgtaacaggaatatgtgaaaaaccagataaagcacacgttagcaggccttacctggtcgtgtaagttacctcaccaaatccagtaaaatcccaaaggtttttacacctcgggacaatgccaatagcaacttgagatagataatttggtgtctttcttttgtaagagagaagaaagtctagtattaaagcagctagggaatggagaatccacatgagtggatcaatcttggagaaccacactaggtcttggcagatcaaatttaggaaagagagatatgaaaggtaaatatctagaaattgattaaattaaaactgttgatgcttttgttgtcctaggaaagtctctcaaaccataccccagtcagtcttggggttccaagagtaaatgtttgaagagagaggaagtggaagctgatagttcttaagaattggttggaaactggcacagccttacttctgtcatattttatgggtcaaagcagttacagaggctgtctgaaattaaggagaagacatcgaccccacttctctacgggagaagtgtcaaaggatttgtgatcatctttaatatgcctcagctactatttgctagacactgtattaggtcattggaataaaataatgaatacaatagacataatggtttgttgcatgaagcatatgatctaacagaggagacaaacaagcaattataatattgcgtgataaacactatgataagagaatatagggtgccatggaatcatacaggaggggcccctaaaccagagagaactggaattcaggcacaacaccccaaaggaagtaccctgagaactctattctgaaccaagtcttattgatatgataatagtacagctataatttttgaaaacatatttctcactcgtgctagacttgaaggaaactagtgacagattttcagtagtagcataaatttgaatttgtgcagaggtgatctagatctgagggaaaatgggcattatttggtttatagagtagaattgaagggatcgttttcttagtacccagcagtagcaacctcccctggaaaattctttggaaaactgcctcatatcagaagaatttgcttgaactgtatttggcagtataccaagtctgtctgtatggcttatatttttctgttgatacattttcttttctctgaaaaggaaaaacccggcaacaaggcctgtgaacaaacagcagtttttctgtttaggtttatataggcctattcctacagttttcagcatatgcatgtgagtctctgtcagttttccaaaacattagaataggaaatgagactgattgattgaatagtttgatcagttagttttgggtttagatacactaatctgcaagaatgtagacttccaatgtaaagatcagcaaagggaaagacttctggataaaggctaagtcaaggctgtaggatttactttagtagcagtttgaaaggaacttgaaaataaaacttcaactaagaagctattgctcttcaagaatgctgttttatcagagaaacaataataaaattcttagaataaattataaatgaaattattagaaagtttatagcaacaacaatatgattaatgaaagttgtattaatgatagagattacctaaagatttgggacatgagatcttgagccagcacaggtaaatttcatgtgaacattggggcaaatcttaatggtctaagtaaagtgttatatgtttagaggtaattgaattctaccgtatcctctttttcttcattaatgttttttgtgctttatgcctttgacttcttgcataaaagcatggagtcattctggtgcacttccatcatagaatgtctctcctatttccgctcttggatcccattgcatagtcagtttatattggccctggatataactgtcattccctagacattaagtaatggaaatattttttctttgcgttgccagtaaatgctggataggatgtatatattttcatttaacagtgagaagtgcttttttcccctttacttcattgctgttatttgtaatgtttggaaagaaacctgagataccagtctaaatgtgagactaagtaattattctatttgatagaatttgctaactcaagcaggatgagtaggatggatatttggcaagcctttggtacttatgcagttgctttttatgcataggagtttatcattctatggatatttctatgtttttcaatcctcatttcaaattgtctcgttttcctctctattatgtcatattcaaacaattgtcatctgtcccattaaatatggtacctttgccaccttctttactgaaagggagtttagaaaaagcaagcaagttatcacatacgggattgaacacagtgtaagtaaagttgactgtttttcctgcaaagttaagctgtagaatttattatgccttttcctctcaccatatagtatcttgaaataattacagtacagactgagaaagacagggatttgtcagctacttcatttctttaattctaatgtcacagaaaagtatgaacatatcttcctaactttatccattttagtatgtaacggtctttacaaattttagcctgaatcacttgtatttaacctaagtttttatttttgattgagatgtagattcttaaactctttgcaataattctataaatatttaagaactattatctttttctcttcatatcttctccgctgcatccttttaaaacctttcctaaaggaacccctaaagggttgtcttttaaaacattgaatcatctttactgttctttcatgaccctttaagaattctctgtaatcagtttaaatcttattataccaaagttaatttgattggaaatatataggactttgatatagttgactgtcaagttttgaaccgagaaagaatatattccttcctctcaagttgttataaaaaaatcgttttctatggattggatttcatttatttccttccttccttccttccttccttccttccttccttccttccttccttccttcgttccttccttccttcctctctctgtctctcttttcttttctttttctgacaaggtcactgtctgttgcccaggctggagtgcagtggcatgatcatggctcactccaatctcaacctctctgggtcttagaagatagaaggatcatttttctaccagtcatttgaaaatggaaggtgttatatccatcttagtaaggatagtatttttattatatggtgggagattttgcacttaggtaaagggagaaaataaggtcattgacttggaaaaactagagagttactttaatctgttaggccaaaaccctcttaaataaagtatattttaaaaattatggaacaaatacctcagttcacttcagtagacatttagagtgcctacagtaagttcagtgtcagtaatagaaaagaaatttccaatgaaatgtcctctttgggctaccaacagttagttaggtctttgatctcccattcatcaccctattcttcatgtaatgacccacatgacctgacacttaactgtgtgcctggaagtacaaggaagagtgggaaaaaattacaggagaaaattctttaaagcatatatatctatttttattttaaaagtcacattctgcacatgtatcccagaacttaaagtatattaataataataaagtctattttctttggaaggaggatttcttcattcaactttcctgcagttctctggttgctagcaaatattgcagagggaaatgaaaataaaatgggaaaattttctatggcaagttcaggattgggaaagacaatatcatagacccagagaatattgagtctcagcttactgaatattctaggtccagctcttcttatctctaaattactgagtctggagaagataactgactgttctaaggattcatagccatgactaaaactcctatttttatccagtgcctttcttaataagaagccaaaaaatatgatagggtctactcagtaaattgtaatgtgttagttttgtaaatccatgttgtaaatggtgagatcaatgcatgtagttatatggcattttaatttattatatgataacatttgactcctttgaagttagtggactaaatgcaacaaaaattagaaatgtggccataaaagtgaccataaaagtaatgtaatttatagttaatatttaaatcacatgcaaaacatgtggaaatatttaataggaaactaaaaccaagcttattagtacaagcatgcctcgtttaatttttgttcatgttattgtgctttgcagataatttttttttgttttttataaattgaaggtttgtggcaatcctccattgggcaagtctatcagtgccattttccaatagcatgtgttcacttgtatctagtatctttgtgtcacattttgataattctcacaatatttcaaataattttgttattattataacttttatagtgatcttatatctgtaatcagatctttgatgttagtattgtaattattctggggtaccatgaaccgctcccatataagactgcaaacttaacccataaatatgtgttttccaactgccccactgacagcagttctcatctcacttttctcgggcctattcccagacacacaacagtgttgaaattaacccagttaataaccctgcaatggcctttaagtgttcaggtgaaaggaagagtcacacatctctcagtttaaaacaaaatctggaaatgattaagcttagtgaggaaggcaagctgcaagctaggcctcttgtgccaaactgttatccaagttgtgaatgcaaaggaaaacttcttgaatgaaattaaaagtgctattccaatgaacataccaacgataagaaagtaaagcggccatattgctgatatggagaaagtttgaatggtctggatagaagatcaaaccagccacaacattccctttaagccaaagcctaatccagagcaagccctaactctcttcatttctgggaaggctgagagaagtcaggaagctgcagaagaaaatggtgaagctagtagaggttggttcatgaggtttaaggaaagaagccatctttataacataaaagtacaagatgaagaagcaagtgctaagggagaagctacagcaagttatccagatctagctaagatcattgatgaaggtggccacactaaacaacagattttcaatggagacaccgcagccttctattggaagaagatgccataggactttcatagctagagaggagaattcaatgcctggcttcatagctccaaaggacagactgattcttttgttaaggccaaatgcagctggtgactctaagttgaagccaatacctacttagcattttgaatatcctagagcccttaaaaattatgctaaatctaccttgcctataaatggaacaagagtctggatgacagcacatctgtttacagcatgatttactgttttaagcccactgttaagacatactgctcagaaaaaaaaagattattttcaaaatattacaaatattactgctcattgacaatgcaccttgtcacataagagctctgatggagatgtacaaggaggtgaatgttgttttcatgactgctaacatcatccattctgcagcctgtggattaaggagtaattttgactctcaagtcttattatataagaaatacattttgtaatactatagctgccatagacagtgattcgtttgatggatctgggcaaagtaaattgaaaaccttctggaaaggattcactagtctagatggcattgagaacttttgtgattcatgggaggagatcagaatatcaatattaacaggagtttggaagaagttgatttaatccctcataagtgactttgagggatccaagacttcggtggaagtcttttgatttctggaaactgcagccatctatgtgtgctatttagatctgaactatcaatgcaatgcattggtaatttggtcacagaagtggcaagagaggtatacagcaacaactggatagtcctcttgtattgatcgtatagctcctcagtgttcttcatcctaggatttttgccatagtgtttcacccacttttgagccagccagagccccagtctgatctgaactatctttctttcttcttacctttatcctttctgtttctccctgtttccttcttttttgaaggcaaattccttcttcacacaaaattcctgacttcaagagttggtaatctagtaggacagacatataagaaagtgaaaaataatatgataagcatcatagtagagaaagacagcagggttctatgggatttctgagggattccaaactcagattgagaatgtgggtcaggaaatatttccaagaggagctaacacttgaactgcctctggtaagcaattaggagctagcctagcagtgaaaaggagctggaggtattggacagatgcctaaatgaatccttaaaacatcactcagagttggaaaccagatagttctcaggcttagttgatcaaatgccaagaacagggtgggaaccttaatgggagatgaagccaaattatctgatgtagcagaagctgagacaaagtggactttgaaaatgagtccaaggattggagcaaagcaaggattccctaggcggtcactgttcattagagtaaaaaagagaagagttgaacattggagcctggagaatgccagcatttaaggggtaagcagaaacaaagagactatgaagactgaggagtagccagagactgacagtgtcagggtaaactggactggaggacagagacactgacccttatttactaatactgtaatgaaggaaataactgggatacagatggaaggaagtttataggtagatagctagaagctgaatctctgtttatctttggagcaaatgaaagtgtactaatctattgagagtatagaggggtgggagtgagggacaggggaaatatgaagtagctcttgtgaagaatcgaagtatagctagtaaggaactcctggcctcaagtgatcctcccattttgccctcctaaagtgctgggcttacaggcacatgccactgcacccagccaacagtaaataattacagcttgtttttgtataccttacactagtttctctgtgttccttggagataacagcaacagtcaagctgcacccctctctgcatcatgctctttcattttctcattgaaagggctgggaaccctgcatgaaatgttgaagactgggcagggttaagaacacccacatagggccaggcacagtggctcatgcctgtaatcccagcactttgggaggccgagaaaggtggatcacctgagctcaggagttcaagaccagcctggccaacagggtgaaaccctatctctactaaaaatacaaaaaattagctgggcgtggtggcagaagcctataatcccagctactcaggaggctgaggcaggagaattggttgaacccgggaggtggaggttgcagtgagccaacatcgtgccgctgcactccagcctgggcaacaagagcgatactttgtctcaaaaaaaagaacacccacataggttggtggcctgcctcagggtgtgaggacaagtgaggtgagaggagaatctgtgtaggagggcagtccagtgccaggtgacagagccccagtgggacgaggaggacttccaggtaggagagctacttacttcagagattggtgtctgagtgaggtgagtggggcatcaacttggggaggggaggcagttggtttcattcaggaggactgatcaaattagtattaaacataatggaagctaggtttctcactataagaaaaagtgaaaactgaagggagacaaccagaatgaaccctgttggaagtattgctgcaaatttatgtttttgatagatagatagatagatagatgacagatagatagatagatagatatgtatatacccacatattcacatacatatgcatgaagtgtatatgtacctatatatagtctctagctctgtccattgggttggcctggaagcagcaacacacctggatcagtgagcacatggaacactcacatctaaatagcattctctaccaaaaggaaccagaactgcttagaaaaattgctgactccagggctgtgccagagtaagtaaaagatgagtttgggatatgtaccaaaaagtaagaatgtacttgaaaaatgatcagtgtatttagtcagggttctctagagggacagaactaatggaatatatatatataggggagtttattaagtattaactcacacaatcacaaggtcctacaataggctgtctgcaggctgaggagaaaggagagccagtctgagttccaaagctgaagaacttggagttcaatgtttagggcaggaagtatccagcacagcagaaagatgtagggtaggggaggctaggccagtctctcttttgacatttttctgcctgcttatattctagccatgctggcagctgattagatggtgcccaccaagattaagggtgggtatgcctttcccagcccactgactcaaatgttaatttcctttggcaacaccctcacagacacacccaggatcaatactatgtatctttcaatcctatcaagttgacactcagtattaatcatcacaagtccaccccttgtcaacttgaacccatatgcatctcctgagatcatacataatcttcaaataaagacaataataaggtcataattatgcttaacataatacaactatccttcctacaactagaaatgcaccaatccccaacccaaatactgttacataaagttaacaatacttaaatgctgatgcgcagttaatcttatgtcacatgataaaggaggaaggaaataaaatgaagatattttcttagtacaagtgtataaatacacaaacatgtttttaacaaaagaaggaggaaatacccatgacaattacagtcctcctttctgcaactggtcatgtggttgtagttggtattgatgagtaccttctactacccattctgtattccctttgccttcagcaaacacctcagcaggttgtagtttttttcctggtggagtgacccaaacctccattcctgaagggtctaggtcatgtgtaatcctgcctggattgggctgttgtagtttctcattgaccttaatcacagggcatggcagtactaagacaagccctaatggatctcttgtattccatgaatactcttccttaccgccattgtggagtagtaaactgatttcatcttgatcgtccaggtcaatcatcccagcaaacactgttactccattcttagcctgttgacttaaaggtatgaggagcccaaagtatctaggtggcaatcttaacttccagtttaatggaatcgttgttgtgtctcctggtggcagcgttcctccctctggaactaagacctctaggccagcagaacgtaatcttgtgggaacaggaagcaaaaattttgctagtggatcactagagatgatggtgagtggtgccacttccaccccttgattcctggactggttaatcctggctgtgggtgagacagtgccatatattggacgctgattcagagtatccgtggccttctggagaactttgcctcagcgctgcaaagtattgtcacctagttggcattgtaactgtgacttcaaaaggccgtttcaccattctatcaatccagctgcttcaggatgataggaaacatggtaagaccagtgaattccatgagcatgagcccactgccacacttctttggccataaagtgagtgcctttgttagaggcaatgctgtgtgtaataccatgatgatgcataaggcattctgtgagtccacagatggtagtcttggcagaagcattgcatgcaggataggcaaactcatatccaaagtaagtgtctattccagtgaggacaaacctctgtcctttacatgatggaagaggtccaatataatcaacctgccactaggtagctggctgatcaccccaaggaatggcaccatatcgagggctcagtgttggtctctgctgctggcaaattgggcgcttagcagtggccatagccaggtcagccttggtgagcggaagtacatgttgctgagcccatacgtaacctccgcccctgccaccatgggtactttgttcatgggcccattgggtgatgacaggggtggctggggaaagaggctgagtggtgtccacagaacgggtcatgtcctgtcacttgattattaaaatcctcttctgctgagatcacccattagtgagcactcacatgggatacaaatatcttcacagtttttgaccggagaggtcgatccacatacctcttccccaaatttctttgtcaccaattttccaatcatgcttcttccaagtccctgaccatccagccaaacctacagcccatgaatccgtgtataatcgcacatctgaccatgtctcctttgatgcaaagtgcacaaccagttgcactgcttgaggttctgcccactgggaagatttcccttcactgctgtccttcagggatgtcctaaaaaggggctgtagtgctgtagctgtccactttcgggtgttatctgcatattgtgcagaaccatctgtgaaccagccccttctcttcctttgtcagctgatcatagggaactcctcatgaggccatcggtgcaggctggggaagagaagtcagggtggcaggagtggagaccatggacacgtgagccacttcctcatgtaacttacttgtgccttcaggacctgtttgagcccagtcacctatataccacttccatttgatgatggaatgctgctgtgcatggcccactttatggctacatgggtcagaaagcacccagttcatgacaggcagttcaggtcacatggagacttgatgacccatagtcaaatgttcagtttccaccaaagcccagtaacaggccaggagctgtctctcaaaaggagcttatttatctgcagaagatggcagggccttgccctaaaaccctagaggccaccactgtgattcacctatggcggcttgccaaaggctccaaacagcatccctatctgccactgacacttcaagcaccattgggtctgctgggtcatatggcccaagtggcagaggagctggcacagcagcctggacctgttgcagagccttttcctgttttggaccccactcaaaactggcagtctttcaggtcactcgataaatgggctggagtaatacacccaaatgaggaatgtgttgcctctcaaatcaaatcggcctactaggcattgtgcctttttcttggttgtaggaggggccaaatgcagcaacttatcctttaccttagaaggaatatcttgacagtccccacaccactggaccactagaaattttactgaggtaggtgatcactgaattttagttggatttatttcccatcctctggcacgcaaatgtctcaccaatacattcggtgtgtttgctacttcttactcactggatgcaatcagcataatgtcatcaatgtaatggaccagtgtcatatcttgcaggagcgaaaagtgatcaaggtctctctgaataagattatgatacaaagctggagagttgataacccctgaggtagaacagtaaaggcatattgctggccttgctagctgaaggcaaatttcttctggtgggccttatggacagcaatggagaaaaaggcatttgccaagtcaatggctgcataccaggaaccaggagatgtgttaatttgctcaagcaatgaaaccacatctggtacaggtacagcagctgcaattggagtcaccacttggttaagcttacaataatctactgtcattctctatgatctgtctgtcttctgcacaggacaaatggaagagttgaacggggatgtggtaggaaacaccacccctgcgtctttcaagtccttgatggtggcactaatctctgcaatccctccagggatgcgatatagtttttgatttactatttaggtagaggcagctctaatggtttccatttgggctttcctaccataatagccctcaccctaccagtcagggagctaatgtgggggttctgccagctgctaagtatgtctatgccaattatgcatttctggcaatggggaaatgaccataggatgagtccagggactcactgtaagttggacctgagctaaaactccattaattacctgacctccataagcccctactttaactggaggaccacaataatgtttggggtcccctggaatcaacgtcagctcagagccattgtccagtagtccccaaaatgtctgatcatttccctttccccagtgcacagttaccctggtaaaaggccagaggtctccttggggaagggtgggagaaagattcactgcataaattgtcggtaatgtactggggtccttcctccaggggatctggcctccctttcattcaagggattgtgggtttgtaaactggctcaagtctggaaattgattgaggggtcatgattctctgtttttataattcaaattagccttttgtccattcgacctagaaattttcagattgtgtagattaagtaggaacgcagtaggtttcctatcagtttcacttctagctctacataagtcagactattctgattgctgcattgcctctgctctctattacggtagctccacccaccttgcgtttgaaggttgagtgtggccacttggcccctgccacctcaggatccaattattcccattgtatttaaattttgtagttgagtgactgtagttcccatgttacatctgacatgcagaggagagcaagtgcaaggcttttcaaagatgtaggtgctaccctcacaaatctgctttgcaagacattggtcaagggtatatcttctggacccaccctactgggatgagtcagtctaaagtgactaatccattccaccaccccaatctccctaagcctttggatcccttcctctacattaaaccaaggcagatcaggcatttccagctcactcacagtgggcaatcttttaatccatatttcagctaaccaagtaaataaactattagaactttttgtaaccccctgagctgcaacattaaatgcagagttcctatttagtggccccaaatcaataaattcagcctgatacaactctattttccttccaacattattccacacccttaatatccactcacatgcctgttctccagatttctgctgatataaatgggaaaactcaagcagttcttttcaagcataacgcacctcctcatgggtcacactttcaacctcacttctaggggcctgccgggacttttgtctagttataggtctagaagcaaacagaggtgttgggggtggctcctgaggagaatcaacattatcttgagcgcctctgcccagctcccgcatcgtctgggatgtgaagagtgcctctgcccgaccaccctgtctgggaagtgaggagtgcctctgcccagcccctgccctgtctgggatgtgaggagcgcctctgcccagccaccccatctgggaagtgatgtgcccctctgcccagctgcccaccatctgggaagtgaggagcgcctctgcctggccgctgtgcaaccttccaagtgagaagtgacagccttgtgtgtgatcttttctgtcttccccaagtttgcattttcaacattaaagtttactttttaattaaaagtttaaattggagaatataaaaagaaaaaagaaaaaaaaaaacattatcttgcctggcaactgcctcaggggaggccatcactgttgcctcaggtagcgcagggtttatctcctcagacaaaggtggaaaggctgatggcatcatgggtccaggaggggatgttgccactactggagatggggaagctgttccttctggaaaaaagagttcatcagagtttacaaactcagtgtccccagtttcattggggttctcccacacatccccattccaagttgcatggtcccattcttttctaatcgatgccctcactttaacagtagacacctggcaaggctgtgcatgcacctttcattgcaggtcagccacttgcacaataagagcttgtgtctgtttttccacaatttcagctctttctctacaggagataagactctcactctgagcaatcttagcagatttgaggctcagtatatgcttctgaagccaggagatacaatctctgagttcatcattttctttcataactttgtccactgaacttaggagcaaccaaccagctttattatggtcgttggttcaccacataggctcaaagatattaggtatagagtcactaaactccttgcctctcatgagtgatgaatcgggagtgtcaaatgcatatattttgcataactctgtaaacagttcacgccaaggactatgagtgttttccatgctattagaagtagagtccttagcattttgtggtctaatcatattaggcagccaactcccaaaaccccaaaaccaatgaaagaactccatccttaatattcttttccactagaaccactccttataccaaaatctgtattagtcagggttctctagagggacagaactaaatctgaattagtcagggttctctagagggacagaactaatgaaatatatatatatatatatatatatatatatatatatatagagagagagagagagagagagagagagagagaggggagtttattaagtattaactaacatgatcacaaggtctcacaataggccatctgcaggctgaggagcaaggagagccagtccgagttccaaagctgaagaacttggagttcgatgttcgagggaaggaagcatccagcatgggagaaagatgtaggctgggaggctaggcaagcctctcttttcacatttttctgcctgcttatattgtagccacactggcagctgattagattgtgcccacccagattaagggtgggtccacctttcccagcccaccgactcaaatattaaccttccttggcaacaccctcacagacacacccaggatcaatactttatatccttcagtcccatcaagttgacaatcagtattaaccatcacaattgggatatctcaaaagccatagaagccagcttgaagggcctccctctggcaaacctgggacaatttggccatcagatacattatatttgcaatagattaaaacctgttgaataagataataaactatgagcccatactgatctgaataaattgaaagttggatgaagaaacagtatacttacagagttttgaagaatcctttcacaaaatacttgttaaatacaaaggtaggaaagaatgactttgcagtaaagaagcctggaggacgccactttaatcaagtgttaaatgtgaacatcatcactaataggaccggtcggcaatggtgccacctgatagtaaacaatgagaagaagccagcatcacttctgtaatattactgcaaaagatgtataatctcagtctaattatgagcaaacagtatgcaaactcaaatagagggacattctataaaaacactaaattgttcataagtatcaatgtcttgaaagtcaaggaaagactgaggaaatgagattgaccaaagagacctgacaactaaatattgcacagcattttgaactactctttattatgaaggacaatattggaacaactggtgaaatgtgaatgatgtctgaggattagatggtaataatgtgtcaatattaattttctggttaagattatgtaggagaatatttttatttgtaggaaatgcattacatcatttggtagtgatgcggcatcatgttggctatttaaatcatagttcaggaaaaaaaaacaattttatgtaatgtacttcaaagaagaattcaaagaatttactgcacttaatgatcatattgatctgtgctttcttaacattttttccccttgacttcctttggcttcagaaacactggttgtcttacctgttagatcattttcttctcaaaggccattcttagtcaccttattcttttattgtgggtactaatttgtaatgtttttccttggccttctcttctttcccctttaataattcttctatttcttgcaactctaggcatatctatcctaaatttgcatctttatcctagctatttcctgatctttagacctacattttacttgaagttagctttttttagtacttctttttctgtcagtccagatctttggtatataactcagcgttggcttaactcacagggctcactaatgcatactcacattttgtgaaaaatgtggggtttacttttcttatttcaaaagatagtaaaattggcttctgtaatggaacagagggttattaagaaaatttcagaatggctactacctgtactgatccaggatcagggtcataaacttatctccaaaatgaaatacaagtttgattacagtagaaagttgcatgttataaaaaggtgaattttatcttgatacgaaataaacttttagggatattatctgagataacatgaagaagtaagaatattatctcatctcccaaatctgttttgaaggaagaggttatgagaaaagtttgaactatatatatgaaaaagcatccatattttaaaattgtctcaattctaacatgaaacaagaacaaaaataggagtattcttagttggcatgtctaaaattaaacattttaaattgatcaagaataacagggatggtgaaaaggtattcattataattccattcattaaaaaatattgataaatacctttcttatttaaacttttttattttataactgtatatatgtatatgttgaaaattaatgtttttatatccaactgtgtaccagaaagtatgagtcatttctgtgccaaaacacttttggatatctcattcggtttctaattatgaaacatttcaggaagtattgcaaataactcaaatagccctcccgaaatgcttggttttggtgggacgttaccggtcctttatttgttgaactctcttcaaaagtaataattctttctatgaatgaatctctactcagtgcaagagattacaggtggccaaatgactcttattctgaagctgaactcagatataataaacattggcatttaattggtgttaattttggtgtaattcattgtctctcttatttaaaaaaatggtgtttcctgaaaccagtgttatttggaaaaccttggctaactaacaagttcctgagaaatattactggataccccaaagccttgacttgaccactgtgcaagctatgcatgtaacaaaattgcactggtaccccctaaatttatacaaataaaaaatagtatattgccaagaatgtcttagtaattcaacaaaagtgccttctttaaaaagttcaaaaatattttaattttataattatttattgagatcctgctgattttataggctcacattggactatgacagggatccaaaagaaatatataccttataaagaacttataatcaattttgagaaacaaaatacattcatatgaaacagcaagaaaaccatgaaaggatataatgtagtgtcagcttagtaagttaatattcttgttgagtcagacagtcatcagtaatcttcctatagcactgacgtaattttgggttacttaatgagtcaatattaggctggatttatttcatgttttctgtgctttataatatttgattataaaagccttatttttcagcactgaagtcagcacatattgttggatacatactacttgctagcacacttataggcatcaggattacaaatgtaagcaaaatagagattctttgtacttaagcaccttgctgctttgtgtgtacatgtacgctgggtgatgatgccagggaagacacagacagttaacatttgaatacataaataaataattctagatgtttttaagtattgtgaaggtgataaaaatgttggggtggaggtgcactgactactgttatcagagaaggcctgtctgaggagccaagattttagctgaagattgaataatgagaaagaattaagtaggtagttagatttatagtttggagctcaaggagaggtctagagtgatgatagaagtttgagagtcactactatgaatatgatatttaaaaccacgagaggccaagtgccgtagctcacgcctataatcccaacactttgggaagctgaggcaggcggatcacttgaggtcaggagttcaagaccagcctggccaacgtggtgaaaccccatctcatgtctactaaaaatacaaaaattagctaggcgtggtggcaggcgcctgtaatcctagccacctgagaggctgaggcaggagaatcgcttgaacccaggaggcaggggatgcagtgagccaagattatgccaatgccctccaacctgggtgacagagcgagacactttcaaaaataaacaaccaaccatgagagtgcttaagttacatcagtgagtgtagctggagaagagaggagtatagagccctgaaacagttcaacattaagaagacagagaggaggaggaggcagcaaaggaacctgagaagaagcaggtagtgattaggaggaaacgtaggcaaatgtggtatctcagcagctagaaaagaaagtgtttcacaaaagggaaaaccaacaatgtcaaacagtcaagaggtcaaatgagatgagagttgagagctgacctttgcctgaccactttctgctcaaggaaacagattagaaaaatggctcattttaggtctgggcagaacattttcaaaatagacctggaacatttgatcataacagagcaaggaatctatccaaaactactatagacatgtcaaaaggactcaggggacagcatgaagagtctttcacttgctcaagatgagataatatgaatatcaataaggaaaataactataatggattgaaacacatcaaatatgtttaaatccatgagttcaaattgatcaaaaaaagaaaaccaaaaacaaaaccacacacacacacacacaacaacaacaacaactaagtggaaacctctgaagaaatgtagttaaccagctttttaatttaaaaactgataaagagaatcaagcatttttcctttttctatatcaaccgtatccttggatacccaaatagtagatgtggtgaaatttctctttaaaggggtgttccagtaaatacataatgaatgatacaattggaatatcaccattttgtaatgccagatgaattcatgaatttagacatttagcaaaataagctactaacatcacaaaaaggaataccaaatatggtgtgccttctgataacatcaacccatgaaatgtcttgtccaaaaaaattgaacataaatctgattatgcttctagattcaattttcaattaccaattttccaagaatacagaagaaagattaacatgttaacctatatcatagggatgtaattagccaaatctatattgagggaaactctaccagacaaattaaacaatagtgcctatggaaggtttatgatttggtgataaaataataaattaactataaaggatgtgataccataaaagtgaggatagtggttacacttagaagggaagagtctttgggagaaaacccgggatgggttttgggtagctggcaagattctgtttaaatgaatattatgtagaaatgtggttgtcttataacaattcattaagctatatgtggttctctgtatgtgagtcacatttaacaatactagagcaaaacttttaaatgaggataaggcatttacatattttaaattctattattttaatttgtgaagttacttgttaagattttgtaggaaatgggaggggcaagcagtgttaaagactttagagtaaataacagagttgcaaacggcaactaagatcacaaatcaaagaaatcaagtgagctccacatgaaagaactactcagcattagtcagtcacttcagccatctctaacacatgttctcatcttcatgttgaaaatggattaggtggcatatacgttggaaatacctgtttacagatgcttcatgttgcttttcaaagtgcttttatatatattatatcatgacagattctaaatgaatttgtgagtggaactgataatggtatctaaattctctgtacataaaaatagtaaatgtttattaatttaaaaatattttaaaatatctaagagaacaaatctccctttattgtagatgtcaatatattatttcaagtaatttctcccttacttataagaattcctgccccttatttgtttaaggaaataatgtccaccagtttgataaaaattgagataaattaaattgttgtttgaaaaaaaatttaagatattcatggtagtttgacaggcctgaagtaaatgtaaactactcctttttttttttttttttctgcagaggtctctttattactatccacgatcgagggcatattgcttcagttctcaatgcatggccagaagatgtcatcaaggtaagttatcatgtttttccactatagcaaattttttcttttttctgtcccataaaacagtttaaaatatactgacaattctcatgataataggtagcattcattagcttttctagtgaatatcacctaatttatatccctttgatttttacatagtgggttaattttattctgatgccatttagatactaagttttcctattatttctatctaatttcttagtacctccattctaagtaatgataaatgttgaatatgtgatagcatctgaatttctttaagcaaacccttaaattctatctgttgtgtttaattatccactaagaggaatccaagtaggcaagaaaaaaagtctgttaattcatttcttttatcattatgactttaagtagttcatttgacttacctctgtaagtgagctaatgaaaataaaagtaataatagtacttgacatttggtagcattctgaatgagactttttacatggattaactcttataataataataattgattgaggaaagaaaggcacagatgggttacaaagtagcttaagatagtggtgggaactgcatgcaggccccagagctggcctctgagtccctgttcttagacacagggctatgccatcttccttgtctaagggaggtgagaagtgtttgttctccctttggttccctctttcttttctgttgaatgcctagcaactttgtggtatcttttagtaccaggatggaataaatcaatgccttttggtggtacaaaggcacttcagctataacttctgaatgtaagtccgttaatgatctttttaaaattattttaatttttttagagacaaagtcccactatgttgctcagtctggtcttgaactcctgacctcacgcagtcctcctgcctgagcttcccaaagtattgaaacaataggtgtgagctaccatgccttggtgatctttcctatttgagacattgtggctataattgattaatttggttctctagggctcatgccaggaaaacttgtaaattaaaatggtttttattatttccagtgtcctcaatttttttttttttttttttttttttttttgctttctccacctaagttgcttcctcagcttttctgctatcaacaggaccatgttatccacagattctggtcttagaaactaccctaagaaacatcttaattgtataaagcataaatgtctgatcacctaaggatgtttacttttaatcaggaatctaaagaaaatttaaggaatcaacaagttggccagaagtggtggctcaggcctgtgatcccaacactttgggaggccgaggtgggtgggaggattgcttgagctcaggagtttgagaccagcctgggcaacatagtgagactccatttctagaaaaaattttaaaattagctggaatggtggtgcatgcctgtagtcccagctacttggcatgcacccagctacttgggaggctgaggtgggaggatcacttgagctcaggagttcaattctgcaatgtactatgatcacaccactacactctagcctgggcaacagagtgagaccctgtctcagaaaaaaaacaaacaaacaagaattaacaagtcaatagaggaaatagttctgcagtagagagttctagccaatatccctgtaatcgtcctaacagctaggcagtaagctatcacaccatgtttcttgttcttccaactaactgatctctgcatctttaactttattcataagctacttttatcctttggactcttaatattgggcccttactgatgttcttatccctaactatgccctcttttatttaaaaatcttagcatagtgcctggcacatagtaggtacttagtaaacggcagctattgattgtaaaagaatgctgaagataggtaagtgtatcttatatggtctgtactatatacttgaaagtacccatgaaataaaggcaattattaagcaaaatataatcaaaatgtgtggtattataggtgccttatttattcattctgaggagaatattatttagagaaggctggaatagttaagaaaacttttctagcaaagttgaaacttaaatccaacctttgatagttagaaagggaagaatatactattctaagaagggaacaggtgaatgtagatatcaagttcggtaagagaatggggtgtttttagataataaggaaattcacttgcctgactaaagctgagtgttaatattggaatatagtggaattaagattgtttaaggggtaatcaaattactgtaaaaggttttgaaattcagaaagagatttagatttgaaaaaatagaatgtcatatttaacaaggaaattatataagtaatatttgaagaaggttcactggaaacagattttagaatagtttcaagaaagcaggaaaagatgcaaaggttctgcatttaggtaggctacaagaggatgggccttgggaaattaaatgaagggatgaagacaggacacatggagagtatctttgtgtgttcaggagaaatctgcgtatttcatacagaagtttctattcaggtaatgcctagataataatttgtatagtggggtgaagatttaatttttgaaaaacagacatcactgatagaattgtagttgtcttactgatattaatcctgcagttgtgacttaattatcgtacagaaaacatccaactgcttcatttttctgaagcaggagataaagtaggttaaaaaaagcaagagaatattaatttagtgataaactacataagtgacaaaactttttttctttgagagaattcttttactgttaaaatctactcttttatatggaagtatttatgaattaatgctataaatgtacgtttgtaataaagcataaatatcaaatgtctcaaaacatattttaaaaacttctcaaactactacatatctaaatgttcatgtatatgtatattattaaataatataaataatagctttgagagaagaacttagggaataaaagttatgaagaaataagaaagaatgcactgttttttgttttttgtttttttttttttttttgagacagagttttgctcttgttgcccaggctggaatgcagtggtgtgatctctgctcactgcaacctccgcctcctaggttcaagcaattcttctgcctcagcctcccgagtagctgggaggctactcgccaccacgcccaggtaatttttgtgtttttagtagaaacggggttttgccatgttggtcaggctggtcttgaactcctgacctcaggtgatccgcccatctcggcctcccaaagtgtgctgggattataagcgtgagctactgcaattggcccacttttttttttttttaatgttcaagacatatatttagtttaacatagatgagctatcaaaaataagtgaaaagttatgccacttgaaatcccttcagaattttgaaaccaaataacaactctctgtgtttaagcacttttgatgaaatctggaaagcattttataaattattattcaggtcataactaagctaagctaaatgactaagctaactaagctaaatgacaatattactctccttataaaacatatcattaaaaatatttgtaagtataggcaggccaactggactttacctatgtaaagatcacattcataaaagtatatattatcaacgatatgtaaaaatacctctatttgtggtaatgcagtaaataaaactgtctgttaaatacacattagaagtaccaggactttgaaaatttggccttaatttaatttaaaaaacaaagttatagttatctgcagtatttatcttttttaccttaaatcagggctaagttaacccagtagtatcggattgcttcctccaaaagagcatcacatattgatccactgctatttgacatggaaaatcttccaaagacaaatgtattgaatgtgcaaaaatgattttcacctacctcccaaatgtatttgcttttaagacaatttttcaagagctgaataatataggtgaacaggaaattaaataaaatatcttagaagtatattttaaaatatattctgcaatgtggtatggtgaaaagagcactgtactaggaattaacatatgtgggtttctggttctttgatattaaccaagtaaatcactttaggcaaattatttcagttctctgatttttcagttaactaatttataaaataagaggaatagatggaatatactttagatttctctttacatctaaaatgctataactttataattagctccagtgaaataatagtaataatagctataaatttttaagaatttgtaatgtaccaggtactgtggtaagttctttatatatcatgatttcattttatgtaatcatagttttattcaatttactaatatttattgattgtttactgtgtgccaaatgctatactaggtgctgatgtacagtggtaagcaaaaagacctggttcccaattttatacagctactctgaaaagtacctttattactcccaatttaccaataagaaacagaagcttaaattcacccaaggccaaataactgacatattcccacgtttctctgaatatgatgagtgtagcagtttgtagactatctaataaattgtgtttcataagattggttttgtttaaattcatataactgacatgaatcacaaagatgttcaataatgatatcaaattacatagaattaaaatctccacatgattaaagtatatgcttcataaatattcaagttaattagaaataaactaaacaggctgggcacggtggtggctcatgcctgtaatcccagcactttggaaggctgagacgggtggatcacgaggtcaggagtttgataccagcctggctaacatggtgaaaccctgtctctactaaaaatacaaaaattagccgggcgtggtggcgggcgcctgtaatcccagctacttgggaggctgagacaggagaattgcctgaacccggtaggcagaggttgcagtgagctgagattgtgccactgcactccagcctgggtgacagagcaagactccgtctcggaaaaaagggaaaaaaaagaaagataaaagaaggaaggaaggaaggaaggagaaagacaaaattcattaagtctagtggaaaattttcaggtaagaagtagcagactgtactggacatgtttcaaagatatcaagtgattataggagttaaggagaatgggtcagattgttgtaaaaataggaggatagggccaggatgcataaactgaagatcagagcatttagggcagagatataacctcctcaatctcttcagtaactatgcagtactttactaaggacactcttgctcaaaaccaccctgtgtttcttttggttcccagtctgagctcttatttccctatactttacccacttgctcttcttgattgaaaagttatttggtatgtttgaatctttatgtgcacacttgcccttctttttaaaataacctaattaagcatatttataaatcaagttcatttcttcaccctattcttccacaattacaatttataaaatctttttcataaatattcaatttatgttttttaacagcttactatttcactagtagtaacttcagaaatagagtcagaaattgtgtctcaggatttgtgaaaacttgttaataggtaatttttctttttcttccaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggtaaataatttacgtctataaggcagctatgtacctttaaaaatggcatcaattcttgcattttgaacttattccaggaactcataaaattcattcttttttgtctggttctctttctctctccaaatctgccctttactgttgtaagaaaattacttctcctgttctccttttcccatcttaataacgtgattaatcttttatttgcttccctagtgccttatgttgctttgatatgtatttacaccattattctatagaatatatgttttactttaaggcaatagttttaaaaattatttttttattatataggaactaataccatgggatttattaaatttaatcagtctgaaatattcttgttttaaaaaccatattgaacctaaaatagatcatttggagtttaacttttctcaatcatgactttatattttagaatcttaaagtcagatgttaagtactactttttttttgctcatcctttactgctaatatttaggattaactagctaactagatactagaagttaaacatagaattctctgaaatagaaatgaaagataatagtcagttaaggatgaacttttaaaaagttatttacaaatttcagacctaggtcccaaacagatatatcatcaaataagaccttgacacaaatacatacatgcattatgtttgttttctttgtctccttctaaaacaattgaagatataacttttgatctgtaagtaatgtgaaatatatttttgcatgagcaaaaatacagatagtgacttaaacagttatgtttttaacctacacatagaaagttacaatgtttaacttgatctatgcatgaatgctcacttaacctttatcaaaggatacattttaataaaaatacattgcttatctggcattttctaataccaatagaagtggcttagaaattatcaaagctggcctctttaaacaattgtcctaaaattgtgtgtatacattgaacattaacatttcctctttaagccaggagaggtggtgtgtacctacagtcctagctactcaggaggctagaaggtaggaggattggttgaactcaggagattcaggatgcagtgagccatgatcgcgcaattggactacaacctgggctacagagtgagaccctgctctaaaaaatttaaattaaaataaaataaatatatttcttctttattttaaaaatatattttaaaaattgttatgtgataagttgcattgaaataaaatagtttatttattattattttattttattttatttttttttgagacggagtcttgctgtcacccaggctggagtacagtggctgatctccgctcactgcaacctccgcctcccgggttcaagcgattctcctgcctcagcctcccaagtagctgggactacaggcacatgccaccatgttcggtgaattttttgtatttttagtaaagagggtgtttcaccgtgttagccaggatggtctcgatctcctgaccttgtgatctgtccacctcgccctcccaaagtgctgggattaccggcgtgagccaccgtacccggcctatttttttattttctttaagacagggtctcactgttgttgcccaggctagagtgcactgtcatgatcatggctcactgcagcttcaatctcccatactcatgtgattctcccacctcagcctcccaagtagctgggactacagttacatgccaccacagccagctacttttttgtttacattgaaatcaaattttaaaaatcacaaaaatatgtaatatatcttaaaaatcctgtggagaaatgaggaggaatatataacaacaaaacagacatgcaaaaatgttagaatttggcttttttttttttttttgtaagagataggatgttgcactgccacccaggctgtagtgcagtggcactatcatagcttattgcagccttaaactcctgagcccaagtggtcctcctgcctcagcctttcgagtagctgggattccaggtgtgcaccaccacaccaatctaattttttttaacctttttttttttttttagacggggtcttgctatgtatgttgctcaggctggttttgaactcctggtatcaaacaatcctcctgcttcactgggataacagtgaagttttaaacagttttaaaccttggccatttattgagattgtttgtataatgtggacattaaaaaaaagctgtgcactagtgaaactgtaacactaggacacttgcattgatagatatgtattatatgaaagaattgatttcatgagagagattgtattatatgaaagagttgatttcatgaaagtaggtcttaaaatagccaaattgatggttgtcttgaattttccacattatctctgtttagtgtatgtttctttcctgttttggtattcattgcttttatgttattacatttctatccagtatcttacttcctcagcctgcagaacgcatccacctatccttcacgaaatttcttactttaaccagctgtagatctagctttttctctctctttttattaagacatgtctggttcatactacatttcaaaatttttaagctgataattagaaaataatctgattatctaaatgaatctactgttaaaatgctgtgtattatttgtagagattttgcttactgccattcgactttcaggaatattaagggcagaaaattaagtgaatggtgaacctttaactctttgacaggtcaccggagaatacctttgtcactttgagagtgacagaggtctttgagagacctttctgaaactcctcaaattgcatttggtagatttaattgaattagaccaacattgagtacctactcattatgttaagtgaaataaaccaggcacagaaagacaaatatcccatgttctcacacccgggctaaaaaagttgatctcatggaggtagagagtagaatgatagttgccaaaggctgggaagggtgtgtgtatgtcaggatagagggtgggaggatgaagagaggttggttaaggggtacaaatatgtcaattgaaggaataagttctaatgtttgatagcagagtagggtgactacagttaccaacactgtattgtatatttcaaaatagctagaagagaagacttgaaatgctaccaacacatagaaatgataacgcaaggtggccgggggtggtggctcctatctgtaatcccagaactttgggaggccaaggcgggcagatcacctgaggttgagagtttgagaccagcctgagcaacatagagaaaacccgtatactaaaaatacaaaattagttgggcatggtggcacatgcctgtaatcccagctacttgggaggctgaggcaggagaatcgcttgaacccagggatggaggttgcagtgagctgagatcacaacattgcactccagcctgggcaacaacagcaaaactatgtctcaaaaaaaaagaaaagaaataatactcaagatgatggactccctaaataccctgactggatcattacacgttccatgcatgtaaccaagtatcacgtgtaccctataaaaatatacaaatttatgtatcaataaacaaatttttaaaaagtattgaatatctgctatctatcaaagcctaagcaaagcctaggtaatatcggtgtaagaaactagattttgccagcaggatgctctgaatctagaagaggagatacacatgtaactagttgcagtatgtattaattgctttctttggtaaaggcttttgaaggcatttagcaaaccaattctctgacagttattatatactcttgttactggtgaacaaagaattggacaaaacacacaacgcaaggaaagaataaagcaagaaaagaagagatttaatgaaaatgaaagcatactccacagggtgggagcaggcctgagcagccgctcaaggacctggatacagaatcttctaaggtccaaatacccgctagaggtttcccattggccaattagtgttcaccccatttaaatgaagtggtggcctgcaatcagtctgattggttgcagaaagcaaccaatcagaggctgaagtgaagttacaaaggtcacactcctagcaaacatctgattggttgtggaaagcaaccaatctgaggctaaagtggagttacaaagctgcccttctgtgcaaatgaagacttggcccacagtcagtgtgattggttggggacagcaaccaatcagaggctgatgtgaagttacaaagttacactcctatgcaaacgtctgattggttgcaaaaaccaaccagtcagaggtactttcaatttctcatctgccagcagaaaaggtaggggtttgcaaagggagtagcctctggtcattttgttacttaggcgtagaaagttagggttttcctttcaattttgttccaggaagtcagtgcaaaacggccttagattccccgcctccagaccctattctcctgcctcattcttagtcttaaactctgtattactgttatcttcttatatcttgtctttttaaataaatcatattttgggaatttaattgtaaaaatgtatactagtaaatgatcaactagagttcttgttctaaaaggagagtaaattatttgttccctttataaaaggtagtttagctgtacccagagttaaactacagagtttacaggtatacgtactcttcaagactgccctcatttctgacatcaactgcaagttgaagagcttcccgaaaccaacttcaggcttgataatttgctaagactcaaaaaactcactgaaagctattgtactcacagttacagtgtattatgggctaaagatacacattaaaatctcacaaaagaagagatgcatagggaagagtctagaagagtcccaaatgtgaagtgtccattttcctataaaatcaggacatgttacccttccagtatggatatgaaatatcaacatgtgtcccactgttcagagttttattggggctccattacctagtcatgattgattgattgattgattgcccaggtggttgaactcagtctccaggttgaccgatactgtatgacgcagatgccctaccccagatcacatggttagtctttctggcatggccagcgttcacccggtgactctcagttatggtcgctaagctactagataaaaggattaggcccttattcaaactggttgaatgcttgtcaactgtcaccagagtccatccacagaataaatagaaatataagaggcaaacagacaaaaaggaaaatagatgtaaattttattgttaattaagcagaattaagttttaagctcagataagattaaggatttgatcatcaaccttttaaggaaatatagttcctatgctatataaactgtcccagagcatactaaaattgacagcttaacatttcagtttttaaaaagagcataaccttgatatccaaacttggtaaaaaaaaaaaaatagcacataacaagaaattgctaattagtctcatatttacccatgctcccagtttcaccacttactagtggtgtttctgtgttttgctcatgtaaaatgagtacttacctcatagaggtgtcatggtttaatacatttagaatgcttaaaattgtgactggcattttgaaagcacttggtaaatgttacctcacgtgaacatagatgtagaagcaaaagttctttataaaatactggcaagtaaaatcttgcagaatattttaatgttgaaataatgtttgaaatctattcaaaccattagctgcatcataattaatggtgatatattagaggcattattttaaaagacaggacacccgttatcactgctgttttcttttttattattcagaaaattctagcctgtgtaataagacaataaaacaaaggagatataactgacaggaaaagacaaaattatcattatttataggtaatatgtttatctattactgaaactcaagaaaaccaactaaaaaatactgtggtcaaattatagcactcagtaaagtggctgcctataaaacaaatattcaaaacttaatagcttttctatgtacttgtaataaccagttaaaaattaactcattcacagtagcaacaatattctattctgctattcttctaatgttatatagtatttcacatttcttttcttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggctgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaggctttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattacctttggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatctccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgtaataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatccttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctggtttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttatggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttattccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctgggggtgcctcccagttaggttgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaaaggaactccctgaccccttgcgcttcccaggtgaggcaatgcctcgacctgcttcggctcgcgcacggtgcacgcacacactggcctgcgcccactgtctggcactccctagtgagaagaacccggtacctcagatggaaatgcagaaatcacccgtcttctgcgtcgctcacgctgggagctgtagaccagagctgttcctattcggccatcttggctcctccccccctgacttggagttttatatcagtatttcacatttctaagcaaagaaatagttacatattatttggttaatcagaataattaattttggggcaagtattttttttctaaaaactgatcaaggtgtgttgtatttattaagcaaaatatgttttcatctttgactcaatttgcccttaattttattgactttcgggctacacatatcaactgtattccgttagcaatacagtgctgttcaggataaaaatagaagttgtttaagattctggattaacttttctgttgcttaaaatagatagaaatgctccaacatattactttctccatttgagctcttggagttcaaaatatgttagtaatattgtaacctgtaaaacatcctaatctaaatttttatggtctttaactcataatgtgtgtgaagaatagaaaaatatttggaatcaactgagttgctactcataatgttcttattttattcattctgacattttgtattttttgtatttattctttcactgctgctttactgagaagacaggaaggaaaacttaattatgactgagtctatgagttcatttaaaatgtaatggtgtttttatgtagtggcagtttcacatatggaaaactgattttagtcaaaatgttcctgtagtactaatttttaatcttaattgcttttttgaatctctgcatattttacacttaataataaaaatatagaaactgcttgataatatcacttagtttcttatccagaataacctagcaaattttaataaaagtaaatcccctttaaatacaaattataaatgttttcctcttttatcatacctacatgtactggatagtaatgaaaatagaaatggaattagctgccagttaataagacagtcttcacttgccataaagatacacttgcctgactgcttttaagcttctgcagctttcaactaaaggaaatttaaggaactaagatgccaaaacagaagtacacagaagtacttggctaaaaaatattcttatttttttatttttattttttattttaatagccttaagggtacaagtggtttttggttacacggatgaattatataatggtgaactctgagcttttagtgtacccatcacctgaaaaacattgtacccaataggtaattttttatcctttacctacctcctaccctcctcccatctgagtctccagtgtccattatactgctttgtatactcctatgtacccatagcttaactcccacttataagtgaaaatatgcagtatttggtcttccattcctaagttatttcatttaggttaatagcctccagtttcatccaagtggctgcaaaggacattgttttatcctttcttatgactgagtggtatactatgatatatatgtgaaaattttctttatccactcattggttgatgggcacttgaggttgatttcatatcttcgcaattgtggattgtgctgtgataaacatacatgtgcaggtgtctttttgatataatggcttcttttcctttgggtggatacccagtagtgggattgctggattgaatagtagatctactttatgttctttgagaaatcgccatgttgttttccatagatgatatactaatttacattctcaataacagtgtataagttttcccttttcaccacatggtgccaacatctattgttttttttgactttaaaataatggccattttgattttgtttagatggaaaatactcttattctttaagttaataatactaagtattaaattaggtagggtgtttgtgtttatattttcatctcatctttcctctgttatttcacagtccatattttctttaattgtgaagcagttgctatataaagtttacttgttacgtgaagtaaattttctttagaacatgtcatgtttaattccttctttttttgctgttgccaaatcttttcatagaaattatgttgattatatgtctgtttttcttgtatatgactaatattgaggcttgctatttgactaaaaataatttgagtagatgttccttgtgttcccttcctgcttgtttggacattattatgtcttaaagaaccttttcatacgttatatgggatattcttttttttagggttattgtaacaaagagccatagactaggtggcttaactgacagaaatttattttctcacagttctgggggctggaagtccaagatcaatgtgttggtagggttggtttcttctgtggtttgtgtccttgacttgtagatgcccgtcttcctctggtgtcttcatacagtttttcttctgtgtatgtctgtatcctaatttcctcttcttttttttttttttttgagatggagtcttgctctgttgcccaggctggagtgcagtggcatgatctcagctcactgcaacctccgcctcccgggttcaagcaattctctgcctcagcctcctgagtagctgggattacaggcgcccaccaccacgcccgactaatttttgtatatttagtagagatgggtttcaccatcttggccaggctggtcttaaactccggacctcgtgatccacccgcctcagcctcccaaagtgctgggattacagacgtgagccaccgcacccggccaatttcctcttcttaaaaggaccagtcatattggattagggcccactctaatgacctcattcaacttaattacttctttaaatactctgtctccaaatacgtcacattctgaggtactgggattagggattcaacatatgaatttgggggcaacacctttcaacccatagcacatgatcagtcctcaagaggtcacgggcagaatgagtaggagaatgtgatttctgcgtattctttgcttattaaaccattgctccaggtctcagcttttctgtgtctagttttatgtttagtctggcctctggttgatgtgtacagtgtacccttgccacttcagacaagtgatcctgtattggaatgaataccagtcatcattagtaaagccaggggagagaagaaaattctcaactcccaggagtttggcttggagtttcatttgcttgctctttgtggtctcattttgccccaccctctctaaattagaagatcttaatagattttatcaagaatttatttatctgtttcctgagacactacactagtgccttgggaaagagaatggggtctttctttagtttgattttatgcacactataactagcaggaactccttgaaatttttatgtaaattttagaaatactgattgtatagaacaaaatggaaaatttatttaaatgagacagaaacctagtaggaagtagaatggttttattttaacttaataatacaagttcgaaataacttaataatacaagttctcaccacttcagaattatcaggggcatgtgttaagaatgcagaattttgcaccctgctccagacatactgaatcacaactaaattttaatcatttttatttctagcactttttaataatcatgccagctcatatgcatgctgacattttagtggtactggttttagactcttacctgaatgtgatggttactttgcttattcttattgatgacatgaggcaacaaaacagcaaaagttatatattatttatttatagaatccataacaaaaaatgagaaatggtaacaaagaaaataattttctgtagattataaattgagtttaaaaataaatgctagaatgaggaatagttacatcagtatagaagataaaggtgtataatgttcttaatatttaaagaatactttcaggtcagtaagagaatattagactaggctcagtgactcacacctgtaatcccaacactttaggaggtgaagtgagaggatcacttgagcccaggagttcaagaccagcctgggcaacataagcaagaccttgtctctgcaaaaattaaaataaaattagccaggtatggtgcctgtagtcctagttacttgggaggccaaggtgggaggattccttgagtctcggagttcgaggctatagtgagctgtctatgatcatgccactgcactccaggatagacaacagagtgagaacttgtctctaaaaaataattttaaaagaagacataaaaaaagagaacactttaaagtaagtaagaaaatgtgaaatctccactatacaaattgcctaaggacatatggacacagataatttacaaatgaagaaataaaaatggtcaataaacttatgaaaaaatgcacaacagtaatataaaaggaatataaatgaatgctgcttgagaacagttttgtgcctatgtgccacacagagacacacatatagcaggtacagatatgaatttattgttacttcttatatatttatatgtatatttcatgatataggcatgatatgaaaagataccttatttgagactgcaacaaaatagacatacttattatataccactggaggtgtgatgaggtgctgttaatttattcatacattctaggagagcagagtaccagtacagatgtttgtctattgacacgaaagctttcatcatatattcctttgtgaaaagaggttaaaatatactctatgctatcatcccaaatttggacagataatcttatatatgcatagatacaaagaaaaggacctggaagaatatacatcaaggtgctaatgttgggtagttctgaatgggtagagattattggtattctttggttttaattttacttttcagtgctctcaaacatttctgataaacaaatattgcttttgtgatgagaaaaatacttataatattaagataatatttttaaattctcagacacgtcagattgtaaagatagaaatgtgggagacaaaaacaaggtgagatttgatagtgattactattaacttcaaataaatagatgcttcagttataaattctgaagggtgcagaattgagataatgtgaatagtaagatcattagtataattaccaatatataccctccttatctcctttttttgagctctcttatatttccatatgtcttattccttacttttgccccagtctttttccttttctcaggcttgtaaattttcataagtcttcagtggcaccacatgcatttagtgtaacacctagtgctaaagaagttccacccttttttaagtgcttccttaataccaagtatttattctctaacagtgatctattgagtgtttgctcctgaccataagaagtttttaatccagtaaattaatatcacttctgtgccagtctactttgtctgtggaaccattatcaaaactgaataatgttgttaaattgctttttgtagatactaatttttttgtcagccaaatctctgagaatgcactaattattcaagccttgattatcttaattaaaattatgaaattaaaaaaactaatttttaacagggacattattatgattggaagaatttttttatatactttaagttctgggatatatgtgcagaacatgcagctttgttacataggtatacatgtgccatggtggtttgctgcactcatcaacccgtcatccacattaggtatttcctaatgctatccctccccttgccttccaccccctgacatgccccgctgtgtgatgttcccctccctgtgtccatgtgttctcattgttcagttcccacttatgagtgagaacatgcggtgtttggttttctgttcctgtgttagtttgctgagaatgatggtttccagcttcatccatgtccctgcaaaggacgtgaactcattcttttatatggctacatagtattccatggtgtatatgtgccacattttctttatccagtctaacattgatgggcatttggattggttccaagtctttgctgttgtgaacagtgctgcaataaacatacgtgtgcatgtgtctttatcatagaatgatttataatctttcaggggacctgccccaaaaatcacgtaggttcttttctattttcctaagcatcggctggcttgagaaataaagggacagagtacagaagagagaaattttaaagctgggcatccgggggagacatcacatgttggtaggatccgtgatgccccaaaagccacaaaaaccagcaagtttttattagggattttcaaaaggggagggagtatgcaaataggtgtgggtgacagacatcaagtacttaacagggtaatagaatatcacaaggcaagtggagacagggtgagatcacaggaccacaggaccgaggcgaaattaaaattgctaatgaagtttcgggcaccattgtcattgataacatcttatcaggagacagggttttgagatcaactggtctgaccaaaatttgttaggcgggaatttcctcttcctaataagcctgagagcgctatgggagactggagtctatttcatctctgcagactcaaccataagagacaggtgtgccccgggggggccagttcagagacctacccctaggtgcgcattctctttctcagggatattccatgctgagaaaaagaattcggtgatatttctcccattcgcttttgaaagaagagaaatatgcctctgttctgcccagctcaccaatggtcagagtttaaggttatctctcttattccctgaacaattgctgttatcctgttcttttttcaaggtgctcagatttcatattgctcaaacacacatgctgtgctgtacaatttgtgcagttaacgcaattattacagggtcctgaggtgacatacatccttcttagctgacaggattaagagattaaagcaaagataggcataggaaatcacaagggtattgattggggaagtgataagtgtccatgaaatctttacaatttgtgtttagagattgcagtaaagacaggcataagaaattataaaagtatcaatttggggaactaataaatgtctataaaatcttcacaatccacgttcttctgtcatggcttcagccggtccctctgtttggggtccctgacttcccgcaacaataatcctttgggtatatacccagtaatgggattgctgggtcaaatgatttttctatttctagatccttgaggagtcgccacactgtcttccatagtggttgaactaatttacactcccaccaacagtgtgtaaaagcatttctatttctccatatcctctccagcatctgttgtttcctgactttttaacaattaccattccaaaaggcatgagatgatatctcattgtggttctgattggcatttctctaatgaccagtgatgatgagcttttttttatgttttttggccacatacatgccttcttttgaaaatgtctgttcatatcctttgcccactttctgatggagtgttttggttttttcttgtaaatttaagttccttgtagattctggatattagcccattgtcagatggatagattgcaaaaatttctcccattctgtaggttgcctgttcactcagatgatagtttcctttgctgtgcagaagctctttagtttaattagatcccatttgtcaattttgcttttgttgccattgcttttggtgttttagtcatgaaatatttgcccatgcctatggcctgaatggtattcccaaggttttcttctagggtttttatagttttaggtgttatgtttaaatctttaatccatattgagttaatttttgtataagttgtaaggaaaggggtccagtttcagttttctgccagttttcccaacaccatttattaaatagggaatcctttccccgttgcttgtttttgtcaggtttgtgaaagatcatatagttgtagatgtgtggtgttatttctgaggcctctgttctgttccattggtctatatatctgttttggttccaataccatgctgtttgggttactgtagccttgtagtatagtttgaagtcaggtagcatgatgcctccagctttgtttttttttttttttgtttgcttcgtttttttgtgttttttttgcttaggattgtctgggctatatgggctcttttttggttccatatgaaatttaaagtagttttttctaattctgtgaaggaggtcagtggtagtttgatgggaataacattgaatctataaattactttgggccctatggtcagtttcatgatattgactcttcctatccatgagcatggaaggtttttccatttgtttgtgtcctctcttatttcctcgagcagtggtttgtagtttttcttgaagaggtccttcacatcccttgttaactgtattcctaggtactttattctcttagtagcaattgtgaatgggagttcactcatgatttggctctctatttgcttattattggtatataggaatgcttgtgatttttgtatattgattttgcatcctgagattttgctgaagttgcctatcagcttaaggagtttttgtgctgagacaatggggttttctaaatatacaatcatgtcgtctgcaaagagagacaatttgacttcttcttttcctattggaataccctttatttctttctcttgcctgattgccctggccagaccttccaatactatgttgaataggagtggtgagagagggcatccttgtcttgtgccagttttgaaagggaatgcttccagcttttgtccattcagtatgatattggctgtgggtttagcataaatagctcttattattttgagatatgtttcatcaatacctagtttattgagtgtttttagcatgaagggttgttgaattttattgaaggccttttctgcatctattgagataatcatgtggtttttgttattggttctgtttatgtgatggattacatttattgattcgcatatgttgaaccagccttgcatcccagggatgaagcccacttgatcatggtggataagttttgatgtgctgctggattcggtttgcaagtattttattgaggacttttgtgtcaatgttcgtcagagatattggcctgaaattttcttgttttgttgtgtctctgccaggttttggtatcaggatgatgctgatgtgataaaatgagttagagaggagcccttctttttctattgtttggaatagtttcagaaggaatggtaccagctcctctttctttgtacctctgttagaatacggctgtgaatccatctcgtcctgggcttttttttttttttttttttttttggttggtaggctattaattaataccacagttttagaacttgttattggtctattcggggattcgacttcttcctagtttagtcttgggaggctgtatgtgtgcaggaatttatccatttcttctagatattctaggttatttactagtttatttgtagaggtgtttgtagtattctctgatggtagtttgtatttctgtgggatcagtggtgatctcccctttatcatttttttattgtttctatttgattcttctctcttttcttctttattagtctggctagcagtctattttgttaatcttttcaaaaaaccagctcctggattcattcatttttttaagggtttttcatgtctttatctccttcagttctgctctgatcttagttatttctcatcttctgcttgattttgaatttgtttgctcttgcttctctagttcttttaattgtgatgttagggtgtcaattttagatctttccccctttctcctgtgggcatttagtgctataaatttccctctaaatactgctttagctgtgtcccagagattctggcacattgtgtctttgttctcattggtttcaaagaacttatttatttctgccttaatttcattacttacccagtagtcgttcaggagcaggttgttcagtttccatgtagttgtgcagttttgagtgagtttattaatcttgagttctaatttgattgcactgtggtctgagagtgtgtttgttatgatttcctttcttttgcatgtgctgaagagtgttttccctctaattgtggggtcaattttagaataagtgctgtgtggtgctaagaagaatgtatactctgttgatttgggatggagagttctgtagatgtctattaggtaggcttggtccaaagctgagttcaagtcctgaatatctgtgttaattttctgtcttgttgatctgcctaatattgccagtggggtgttaaagtcttccactattattttgtgggagtctaggtctttttgtaggtctctatgaacttgctttatgaacctgggtgctcctgtattggtgcatatgtatttaggatacttagttcttcttgttgaattgatccctttaccattatgtaatagccttctttgtctcttttgatctttatttgtttaaactctgttttatcagagaccagaattgcaacctctggggttttttttttgttttttgtttgtttgtttgtttttgttttgcttcccatttgcttggtaaatcttcctccatccctttattttgagcctatgtgtgtctttgcatgtgagataagtctcctgaatacagcacactgatgggtattgactctttatcctgtttgccagtctgtgtctggcaaactggggcatttagcccatttacatttaaggttaatattgttgtttgaatttgctcctgtcattattatgctagctggttattttgcccattagttgatacagtttcctcataatgtcaatggtctttacattttggtttgtttttgtagtgcctgtcccggtttttcctttccatattcagtgcttccttcaggagctcttgtaaggcaggtctggtggtgacaaaatccctcagcatttgcttgtctgtaaaggattttatttctccttcacttatgaagcttatcttggctgtatatgaaattctgggttgaaaattcttttctttaagaatgttgaatgttggcccccactctcttcgggcttgcagaatttctgcagagagatccactgttagtctgatgggcttccctttgtggataacccaacccttctctctcactgcccttaaatttttttcttcatttcaacgatggtggatctgacgattatgcatcttggggttgcttttgtcgaggagtatctttgtggtgttctctgtatttcctgaatttgagtgttggcctgtcttgtgagtttggggaagttctcttggataatatcctgaagagtgttttccaacttggttccattctccccatcactttcaggtacaccaaccaaacgtcagtttggccttttcacatagtcccatatttcttggaagttttcttcattccttttcattattttttctctaatcttgtcttcaaactttatttcattaagttgatcttcaatctcagatatcctctcttctacttgattgattcagctattgatacttgtgtatgcttcatgaagttcttgtgctgtgtttttcaggtccatcaggtcatttatgttcttctctaatctggttattctagttagcaattcctctaaccttttatcaaggttcttagcttccttgcattgagttagaacatgctcctttagctcagagaagtttgttattacccaccttctgaagcctacttttgtcaattagtcaaactcattctccatccagttttattcccttgctggtgaggagttgtgatcctttggaggagaagagttattctggtttttggaattttcagcctttttgtgctggtttttgctgatcttcatggatttatctacctttggtcttccctgttggtgaccttcgcgtggggtttttgcatggttgtcctttttgttgatgttcatgctcttcctttctgtttgttagttttccttctaagagtcagtcccctcttctgcaggtctgctggagtttgctggaggtccactccagtccctgtttaccttagtgtcaccagcggaggctgcagaacagcaaagattgctgcctgttccttcctctggcagcttcccccaagaggggcacctgccagatgccagccggagctctcctgtatgaggtgtctgttgacccttgctgggaggtgtctctccgtcaggaggcacaagaatcagggacccacttgaggaggcagtctgtttcttagcagagctcaaatgctgtgctgggagatgtgctgctctcttcagagctgtcaggctggaaagtttaagtctgctgaagctgtgcgcacagctgccctttgcctcaggtgttctgtcccagggagataggagttttatctataagaccctgactggggctgctgcttttctttcagagatgccctgcccagagaggaggaatctagagaggcagtttggctatagtggctttgtggtgctgtggtgggcttcacccagtccaaacttcccagtggctttatttacactgtgaggggaaaactgcctactcgagcctcagtaatgatggacatccctccccacaccaagctcgagtgtcccaggtctgactgctgtgctggcagcaagaatttcaagccagtggatcttagcttgctgggctccatagggatggaatctgctgagcaagaccagttggctccttagcttcagcccccttttcaggggtgtgaatggttctgtctcgctggcattctaggtgccactggggtatggaaaaaaaactcctgcagctagcttggtgtctgcccaaatgaccacccagttttgtgcttgaaacccagggctgttgtggtgtaagcacccaagggaatctcctggtctgtgggttgtgaagaccatggggaaaagtgttgtatctgagccagagtgcatagtcgctcagggcagggtccctcacagcttcccttggctaggggagggagttccctaaccccctgcgcttcctgggtgcagcgatgccccaccctgcttctccttgccctctgtgggctgtacccactgtctaacccatcccaatgagatgaaccgggtacctcaattggaaatgcagaaatcacccaccttctgcattggtcttgctgggagctgcagaccggagctgttcctatttggtcatcttacctgggaatcgataattttttaactttctgatttacttcagaatctctatcttgttcataaatctttgtaatcgactacattgtagtcagacttctttatggtgtatactttaattattaacatgggaaaggagggagaaaagagaaggggaaacgtagcatttttttctcaattgtgtaatttttctaattcacattttagaagtctaaatatattctagacatggagaaagtattttaattctggcagccattagtagcacattggcacttcaacttcagctgctcagaagcctgccagtaattgtttaaagtttttatgccttaaggaacagctgcagtttacagcggcacttgatttcagattttacatttcatctgaaatatatttatatgatataacttgttaactttcagctagctggaaatccttaactcttcttatgcaatacattataagtaagatatattggccaaaccaagacaatttcacaacgacagagggtgccattactaattacaacaggacaacaagtgtgaagaactgggctataatttctgttgcctgtaagtaaactcctcttcagattattcttaacatctgaaggtttaaccttcttaacatcaccctctcagtggcttaaaacaattactgttttattaatgtttatgattctgttggctggcagtttggactggaatggctaggaaggctaggatgcctggcacagctggacctttctccacatcagttctcattcttcagaaattggtcacattccacatataaaatatgcttatcaccatcctaggatttcaaaagtttcatcccactaatagcaacaggtccaaagttcaagaaattgtcatctaaatctgatctagatgcaaatgaggtttcttgggttttgctccttggtggaactcatttctgtgttcccacatatcaaacatacaacggtgaggcagggacagaataaccaccatcaacattctcattcatagctggaggagtaggaatcatatggctctaaatggtacatagcaattctgaaatctaactgggcacatgttgccaggccacctacatggggaagagaagggaatattctttgaatagggcccattaagtttcctcagggtggttctgtagttcattgttcttttttgggcttttggttttgccttctgggttcttggctgtgtcctctgagatatccttcctctttcataagaaatgatctgtattagcagctgaataactttctcagtctgcttcctgactacagaaaattggggacccagagaattattttcatttgaagtgtctctgtcttaataatccaagatagtgccatacccttaaaaactctttaggccttctctgttatcagattatactctactcaatttgacagaggctccattcacaattctttcaaaataggcctccttcctatgttggctggcatgtcagagtgatgcgggaccagttccttttttgttttttttcctatctttttattttttatttttattttattttattttttttattattatactttaagttttagggtacatgtgcacattgtgcaggttagttacatacatatacatgtgccatgctggtgcgctgcacccactaactcgtcatctagcattaggtatatctcccaatgctatccctcccccctcccctgaccccacaacagtccccagagtgtgatgttccccttcctgtgtccatgtgttctcattgttcagttcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattttgtaggttgcctgttcactctgttggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttatttaatagggaatcctttccccatttcttgtttttctcaggtttgtcaaagatcagatagttgtagatatgtggcgttatttctgagggctctgttctgttccgttgatctatatctctgttttggtaccagtaccatgctgttttggttactgtagccttgtagtatagtttgaagtcaggtagtgtgatgcctccagctttgttcttttggcttaggattgacttggcagtgcgggctcttttttggttccatatgaactttaaagtagttttttccaattgtgtgaagaaaggcattggtagcttgatggggatggcattgaatctgtaaattacctttggcagtatggccattttcacgatattgattcttcctacccatgagcaagggcaattaggcaggagaaggaaataaagggtattcaattaggaaaagaggaagtcaaattgtccctgtttgcagacgacatgattgtgtatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaccagttccttttgtctagtcaaggtgatctagtagtcttcactttaaatcattcagagatttcttaaaaagttattaaaaccacacacttaatttcatgtttgaagaccttattttgctatgcacatcttttaccagcaagtcctgtgtcctctatattccttcaattttgctcacaaactgaacattttcttctctagctcttctctgttttagactttattatatagccacaagaagccaagtcagcattctgcctggaaatctcattagccagattcacaaattcattatttcaattttctctattctaggttactgaaggtgtcactttggtcttttttttttatttttattttttgcaggttattcccaatttaagtctttttgagtttctttcagcaatattttgtagtttccagtgtgcaggtcttacacatattttcttaaatatgtccttatgaattttgcattttgggctggtattataaatggagttgtatattttatttcatttttaactgtccattgcaagtgtatagaggtaaaattgatttgtgtatatttactttataaactgtgattgtgttaaattcatgtatttttttctactgggattttttttggtagatttcttagtattttctatgtacacaattatatgtgtacaaataaaaaagttttgcttctttttttttcaatctatatttctttctttttcttgccttattgtaatagctagggtctccagtatagtgtagagtagaagtgatgaaggtaagtattcttgtcttgttccctatcgtaagtgaagagcactcagtctttcactgctaaatatgctatcagctgtgggattttcatagatgtcctttattgcgttaaggaagttcctttctgcttctagtttactgagagcttttgttatgaatgggtatgttatatttaaattatatctcaatttcaaaactgatttaataaaagtgatattacatattatatataccaaaatttacacagggcaacattctcagatatatcagtttaagaaacaacttaaactgtgtaaagttaaaaaatttaagaaaacactagtaaaggctaaaaaatttattttaaagtctgttaactatcatagtaaaggtaaagtaaaaccattgtttgataattttgctttcggaagtggaaaattaagaaaggaattgctatctttccattccttaagctaatatttcaaaactaaatgttatttctctgtgtgattacctttgtctgtaaaatctgaattgcacttttctaattaacacaaatgaaatattttatttttttcttttcctcagaataatctagaatgtttttaacgtttaggaattatttttctttcttatttatttatttatctatttttattgcagcagagtctccttctgttgcccaggctggagtgcagtggtgcgatcttggttcactgcaacctccacctcccaggttcaagtgattcttctgcttcaggctcccaaatagctgggactacagatgcacaccaccacacccagctaatttttgttcttttgtagagacagggtttcactgttgttacccaggatggtcttgatctcctgacctcgtgatctgcctgcctcagcctcccaaagtgttgagattacaggcgtgagccactgctcctgaccagaaattatttttcttatttggtgtataaatactacaggtatattctatgtaacattaagtaattaccctgtaggttaattctgaatcagtatggtaagattttatttctatttttgtcccttttatacagatgaagaaactgaggctcaataaatgatttggttatagttatttctatttttatggtaactttttttaataggagttacttaaagatccactctacattggactacggcagagaagagtaagaggttctgaatatgatgattttttggacgaattcatggaggcagtttcttccaagtatgtatctttatttaacctatattttagtcagtaacaataacataacagactattaaaaaatccaagatttatgcaatatggtttaataattagaagtaatttgaatgaaaaatgcatatatcctatctatttcctcataactgttaatggacaaatgataatatcatgtgtctatccagaatagattatttctgttgctgtccctgaatatacttttttttttacaagaacctttagaacctgtggctgttgaaatgcatgattatggtaaaggaggcagtgaccagtgactaaattacctgcaaacctttttacatttatcgacaatctgtactttctggttgatgataaaatctgatcttcagtcatctttgtagctggtatttgactctcttatggtcaaccaccagccacaaaggaaaagcagaaaaagaggtggggattgagcatgagttggtacagtccacaggggtccagaatggagcaaggacagggcattccatcatgatccatgcatctctgattaaatctataatatttgattaaaatgcagtgctatgtaggttgagagtctcttatccaaatcacctgagaccattagtgtttatgcagattttgaaatatttgcatatatatataatgagatggtacccatatctacacaagaaatttatttatgtttcatataaatcatatacacatagcctaaaggtaattttatgcaaaagtttaaataattttgtgtgtaaaacaaagtttatgtacatcgaaccatcagaggcaaagatgtcactgtctcagctacccatgtggacaatgtatggttgtttggcatcaccattatccctgattctgaattttatatgctagcaataagcaatcattttttgcacttatcatgcataaatccttaacagtataaaacataatataccattaatgcaatgaaaaaaataatgtgttcagggtaactggtggcatcatatcagcgctcaaaatgtttcagattttggagcattttggattttggatttttggattagagatgctcaacctgtatctttttaagttagcatttgattgtgggccagatgctattgtaaatttttccattttttttcagaaaagagactcccaccataatttagtaatatattctaagagaattttatcacactgacagtcatcccttggttactgtgtagccacagaaaccacatactatttaaaaacacatatgttgccttggtttttcttagaaataaagtcatcactagaattaactctaactagagatgcacttctggtttctttttattataatgtttatttttaagaagttttatccaacagcagaaagtgctttcatcagcttgcacaacatttagaatgcattgaacctctcattactcaaggttttaatgctgggtacatttgccaattagtatggactacattttagaaccacatgcttgatttatttattgtaattatttgaactatacttatttatagaaatagttgagaaactctgcagtttgagatcacataatacagttaatttctaatagttttttatacttaaagtgccttatcttgtgaaacgctcatgtaaggttttgaaattatccaacttcctcagtagcaacattaatcaagagattgtatagataataccgtaaggctatataagaggaaaggaaatgcagtctggaataaagtctatctaaataagacaactttaacaaacagacgctgctaacaagttaggtgcacttaaacgctgatgaaataaggggagaaggagtttttattattgggaatcaatgaaaagttttgggaaaaaatgagatacgaacaaattttgaatattttatatcaatccagaatgaagaaaactgttttttttttaaatgtggaattgaggagttaccttagttctttgtaaggaaacagggattgacaagtgtaaacaataattttaaatgtagatagcacctatgaatcagggtttgtacttccagagaaaaatgccaaagactaaaaaaatactttctgtcataacattgtttcaggaaaatgatctagatgtgaaacctaacactacccaattaaattgggaagttgtagtgaagataaacccaagattattttaaaaagaaacataacttaaattcaaagtgggaaatgattgttacaggttacctagacatcagactctgagatagagtttattaaggagtacccttgggccaggcacagtggctcacacctttaatcccagcactttggaaggccgaggcaagcagatcacttgaggccaggatttggagaccagcctggccagcatggcgaaaccctgtctctactaaaaaatacaaaaacattagccaggcatggtggcgtatgcctgtaatcccagctactcagaggctgagagacgagaattgcctgaacctgggaggcggaggttgcagttagccaagatcacaccaccccgcactccagcctgggcaacagagcaagactctttcttaaaaaaattaaaaaaaaaggagtacccattgggataaacctctttggaggagaggacatagtacagaggttatactgcaacatggacccaccaatagccatggataacttagttgggattacccctgcctgctgtttagatacttacatggacactaatttctgcccatcaacctccctctctttctccttcaatgcccatcaacctccccctctttctccatcaatgctatgttggttttttttatttgccatcttggcaggtttagggtagagcagcttcaaattcttcctctcggtcttctccacaatgagagctcttcactcacaggctgaggatttgatatgggtcttgtggcacttaccaagtctgtcttttctgattacacatctagggtctgaggaatcaccaccaggtgggtctgtggtgacagtggacctattatgagccagaacttggctggggctccatttattactggctcctgtatgcctctactctaacagggagaggggaacagtgttttgatgcttcaagtctccaggtatcagtgtcaactgtgtgctcattagttctcagacatttgaatagtccttctccagtgcatagttacttgggtaaagggctgtagttccctgtggataaagattagggggattattaccctgtattcttgtcatggtgttataaggttctttcttctgggaactaggcctcttcttcagtttatgggttctgggtctaaaaattaactcaggttcggaagctgagcaagagattgtgacttcattggggcagctacactcaactttgtggtcattcatctttggtttcttttgatagtaaatattgagtagtagctttgttagctctccgttttgcctctagggatgcaagattccgttaattatctcaaaaacattttgtgggttagccacacacaccccacttttgccactcttatgataattgtgtccatctggcttctgattgttaagcattctcacctggtcttagcatccttattgctatcagtcaggctggttatatatcatccttttcttctgtcactcctgaccttcaggggagaaccaccactgaaatttttagtaatgttgatgtcttctcattggcatattccttatggctttgggaaatggtgtgttttctgggccttcctgtggaatatgttcatcttatggattttctggcttttacatgtgtctatataccagactgcccagttctctgagcctcgcaatcccctcttctgtcatttgccacagcattcctggcatttcagtcatattagtatcagccattaatttgtccatgtttctaggaaccatcctagcaatgagtttgcaccatcttctgggattcttgccacatgttaaatcctgtatctcaggagagtgcctgcaaatcagtaagctctcccttttcctaggttccagcccttttaatcaaacaccctcagaatttaattctacatgtattctcctggctaatacaaatactggtcttgtggctcctttggggtaaagtctctttcttcctttatcaactctagtatgtcccagataggttatattgtgataaaaccttagttattggcccagggatctggaggggaggcagaggtagatggtagttaaggggcacatgttaacttatgggggtgaaatctctacccttatcatcccaagaaagaaggggaaggccactttgtgagatgcgaaagctctgggggaatctggggattcaggatttcgacagacatcaaaccagacatcccattccatgtggcaaattcccattcttttgtaactaggattctgacttagcagatctgctttccttgagtttgggagcttgaatattctgatgattgagccctgtttctggacataagctttctctacccagcagctacagaagctgagaacatctttgtatctacaaaggagggcctctggctttcttgttggcaattactttctctgagctttttgtgttttttttcccattgtccttatagttactctacttctctcatatttctcaaacatctgaaatatcattctagctaagatgttcccttcccaacatctcaactcacctctggtgagttttaatagttggactgctaccttggaccgggcatgtgctccatcttctaccagtggtggggtcctcattaccactgcagcagtgagttaaccagtgccaaagccccatcttattaccagctttctcagactattccaagattaggttacctgggaggcacattcggaaatgaagtttagtgtttaagaggtttgtaagaagtgcccttgagattaaactctgtggaagaaataacaaaggaagcaggaatgggcagaaggagaagttgagctgcctgcaggcaccatgacagctttccctgatcccgtggggaactctgaagctacagtggcttttcagagttgttaccagttgggctgagatggtcaaggctttatattcctgcatcaattagtcactggatgtggatgtgggtcactctgggaaagagcataggtcgtggtctgtggtgaaacgactctttgcagctgaggcaacccccaggacaacagtgggggatccgaggggcatatcatgatattcagcataatttctcaattcagaaagtattgattaattagcttggatattaattagcatctctagtggagtagcacaaatccatttcctagtactggcctgttcaacaaatttatcaattgggcctagtaattctacatctgagtatataggttaagaaaatactttaaaataagaatataggtaaaggaaaaatttgaagcccaacatacagaatttcttctctttgcttccaggatagcacactccccttgctttcctcctgcctcactgattgttccttcgtagttttcctcagcttattccttttcatcttccccactccctgccagctgtaaacattagaatgcttcggggcttgaagcttgaaacttttctttttgctattaatctccacttccttggtaatctcatcaagtcatacatctttatatttgtgactcccaaatctttatctctaacctgtacctcttctctgaacttcagaatcacgtggtaaaactccacttcacatttatactcagatctgtaatagacatagcatatgtaacatgtccagacttggactcccaatctcccactgactcccagccctgctcctgttgcagcctttcccatctcagtaaatgacaaccccattcttcctcttcctgtgactaaaaatgttggaattaccactttgtacccaggccacctacaaaacttagtagctttaactacagaatgtatccagaatctaaccttttctcattgtcagtatcattacttctcttaactgaacctcttttacctggattattgtaacaattttttaactgttaatgaaattctgcttcctcctttattgccctttagcctgaaaattctgtttcactgcttcctcctttattgccctttagtctgtcctcaacacaaaagctgtgatggttctgaggtaatttctctgctcaaaaccccaggaaagcttatcattttattcagaataaaaacaaattcttgcaatagtgtaaaaggccctgagacttctggcttcctgttacctttctcacattatctcctcctagtttccccccttgcccactttgttgtggcctgtttgctatttttctaattcaaactaggtcaaagcttgtctttctgtctacttgacatcctcaccatacctgcctctgcccagttttccacatgactagctctctcacctcctttaacatttcctcaaatatccttttctcaataaggccttctttgatcaacctatgtaaaattttaccctcagcccactttcctcttttcatacatttataaatatctgacatatttgatatttaattatttatgttctgtctctattcatatactgttaagttctatgaaagcagggagttttctttttcctccactgccatatccctagtttctaaaaagttatctagtatgtgataagtactcaataaatatttgttaaatgatggtaaaatttgatttgttttgtttatatagcttaaaatgaaaagtatgaatggaagaacttattagaatttcttttcatgtgatttaatttcaggaaatattaaagctcttaaatatgtgtgtttgtttttgtagttgtactccttatagtatcctttttttttttttacagaatcagttgcccctgaaaattaatagaaatatagagacagcttcagctttactgcctaaaattctctatattagaatttcattaatgattattaactaaatgagaacaaaagctttacctcaagtaagcttttaagaactaatattaaattttttaaatggaataaatagctaatattcaacaaagactatatttaaaaattgtgttcttttttattttaaatgacaaaaattaaaagttattgggaagcactaggaatggccacaaacgtagttattatactacaccctccttcaaccttggctgccatcacaaattgttctgtgatctgtcacataaagtttaagagaaataatcttagtctgaagccatatcatctgccatttgctgccaggtgtgataatgaggttttcatacaattatgctttttttgctgagtagtgttgaacaaaagtcttggctgtgtgcctgaaacagaccagactagtcagagatactatcaagttggtaatagtccttgagggtcacttatcagatttcaagatatatagcctgtgaattatcatggccagatatactaaatttatttctttaattattaatatcatcttttctaaagaaggcatcaaatatgtaaattaatatgtgctcttcacccttattcagggttgcagttagatagagtttcgtccaactctacactaaatccctggcttcccaacagggaagggtctttttctactgccctccttctttctccatttcttctgcagttaatttcatggctaactttctgtactacctttttctacctgttctaatcattgctttttatgcctgatcattttttagatgacggggatatatttataacttacgtgattttatctataagtctgtgaggctctttagattccacctgtcactttgatcagcatgagttactttgcttttcataagaaatttaatgaaagcatatgattatatgggattccacctgctattcttccctgtggacccagggtgaaataaccaggtgaaaaaaataaaatgcaaagaatgtctgtcaatgtgagaaaaatcagcagtcatgttactagggaacatgactcaaatcaggtttctgactcagaatttttttccattttcccatccaaagaaagatcagattcacaattaactatagccatattttccttaaaatcccaactatttctatttataccattctctctacttttttttttcaagtgaacaaaaatggtgggtcatgaaagaattagaaatctaaaggtatgcattatgtgtatgtatgtgtaaaaacatgtgcacttatattccataatggatttaaagtggatgtatacttcagtattttgatatttgatttgcatccctgtcagtatcccagtccaaccttggagaagccagaactttagcaagtcaagtttactgtttcattctgaacatggtttacaactcttccttttagatgctttttgtgcctaattccattttattctaatcaattgcattaattccaccattcctttaatatggatataaatgttttacactgtttttgttctggttacatgagtcttatgcatgcattatttcatttaaccctattttccttactagaatataagctgtgttagaaaaagtactgtattatcaagggattgcttttttctgactatcccatattatattttaccctacagtaggcataaaataactgctgttgaaagcattatttaagcattgagtctaatgttcttgaaactacagtggcatatatctgaagtaaaggtagctccccaacataaactagagaaagacacagttttccaaataaagagtctctgcctatagtaaactaaagatttgagttttaattatatggatacatttatgttttaggttgtaacttttatctaaagaaaagaaacattttaataaattcctgttgtatccattgttacctatctttttctcttagaatttgtaaacattgagatttatatagagaaagcccttaatattttatctgaatttattaaagctaaattattagattattaaagataatcattacgatttgaaaattagattattaaagataatcattatgatttcaaaataatctgtataccatgtttcttttctgtatctctctccttttttattctcttaactttaatttagcaagattaagcccagtttcttaaaagcttgtgtttcttattgttttccatctatagtcccacatataataaattagaaaataagaatgatacatccgctcattggtaacataaaaaaagaagattcaatatgatttcctgagttatagatcaacctaaaaacaaaacaaaaaacactatcaatagcaatatcttgtaggttaaaataaggtcttttgtttataatattttttcttgccatccttaatttacgtgtgtttatagacaaaggtaaagcaggtatgaacatgtgaaagcaatttacttttccttttgaaagaccatctatgtggctggtttggggaaatcttataacaatattagaatgaagtacatatattttaattattagagattaaagatgcggaaaggaaaagaataattaaagaggcaaacttagaaaattgatttgggggtaaggtcagaaattaagggtacttttttggttctgtaggaaattgaaaccctaattgcaactaatatcgtatctggacctaacattagtattgacagtcagtgcatttcagttaatgaaagccaaagtccttataatggccctcaagccctgatgtggcccccttcctgacctctatgatgtgctcactctcctgcacccacattctccacgctgcctgtactgtcattgaactctcaaggcatgttccttagaatattttcacttgcttttccctctgtctaaaatattcttctcccagaaatgtgtttggttaaaaacttaatctttttcatatattagctcaaatcttaaccttcttttgaggtttaccctgactaccctatgtaatactgaaacctgtcccatcttctccccaccctggctctcctgatcacccttgttttgctctacttttccttttttaaaataccacttattaccattattcatttattatgtttatgcttattgtgtgtttcttccactagaagatatgctgtcaaggacagggatctactttgttcattttatgaacaagttccttcctgtatcaatgcttggcacagagtagataaacaataaatatttgttgaactcaattgagatacttaaagggaggccacacaagacaatgtgagtggttttgcagaaatctttcaccattactagaaaattatttcatttaaacatgtcttatttttattgaattactagcatcatttttatatggaaaggagagccatcagcacatggtaagtaatgaatacccgattgtctcaggtcccagaagcagattatccctcaaggaattagaggttagttctaaagttagcatgttacatagagtaatctaacgacatttaatgcaagttggtagtaaatattgtttgagctgacatatgtcaaagtctcattatttaaagctacaacaaaatttgtataaaatttgccataatcaaaatgtaagaacaaaataatcattcctgttgccaagatgatcacattctggctaactcaattttccatgatttgactgttacttttatttcactaactataaagcaagccagaattaacacagtgtgccatgttttttattttaccaatatgtagtgattaattctcaagagtgtttttctttgtggtatccacagatggtgacccacttttttcatatcctcatgaaaataatatcatattctgtatatacatggtaaaaatgccacatttgtgaatagaaaacaaaataagctattgttaaagttttgttgaccaatattgttagattgagatgtgtcgaaatttagatggaaagaaaggctcatcctactgagcacaggttggaatggtgctgcctgggacaggtttgcagtccatttcttcagaggtgtcatagaatgacatttcttaattcagttaatttaccatggtttggagcctgactctcagctcaggaagtttagaaatctaattttgacagcttgcaaagctcatatctcaggtacatgtgataagtaaaacttgcactttggagtcaatcctcagctccaccaactactacatttgtaaccttggaaaaattacttaccttcctcaaggcttaattttcttgcctgtaaattggggtaaaatgctaatagtaccttcagtagtaccttcagacagttgttatgatgattgagagaaaacatataaaacaaattacttttatcaagtgctataaatagtaactataatttttatttttcaggaaggattactaggaccataatttagttaaaagatgtaggctggcaaatttggcttaatattaaatagagcatttaatagttggaattgtccccaaagaaaataatgtatataaaagtacttgcacataaaaattactcagaggttgttattccttattgtttctgttgttaatattatttgtgaactctccatcactctgagaacatggacagatgtgcttaaagatataaagatttctacttttatgtgagatgatggattagaattaaatgtttctaaagtgttccaactttaggattctatgaaagtggtaaaaaaaaaatcgtattttgtttcaacattcaggactggttgtttcataaaattcagtgattcagccatgcttgtgatcattatgagtcagttgaaattgatcatcacaatatatttgacccagaggaataaacttctcattcaacattgtaaattattttgttttgcataacaaaacaactttaataaacttcagtaagctttagctttcccttgctacccaaagtttatttcataaagagctcaagagacaattggcaagttaaataattcaagagaaaaaatgttcacaagaagtttttatttgctttgcattctattccctatgctacatattaattgtacagttagcttcaaagtaagtttgtagtaaaaattactttcacaataaaaaaggtacatagatacaagcaactagcaaattaacttcgcaaagaataagatgtgggtttacataagccatttatgccagttaactagaccagttctcaactctctctttttttgaaacatctgtatcagtatcatctgattgtatcctaaagcagatatggaaataatttattattcttgggtctcttctgtgaccccattattgtcctgtgcatttatctcaagatcagattcattattaaatctatccagacaattcctctatcatgtccttgatccatttctataaccataacccagtttctataatcataacccaacttcaccattttatatctttacaccatctcggtaacttctgattttctttaggatcatattaataagtattcaggaacttacctttaccctgctattgactgttttcacctacatataaatccctttgtgatctggcccatgcacttcaccttcctgtctgccatcctccacccctccgtgtatcctttacaccattgtataaataaatagttttagttggctgcacatgtcattgttctgtcacacttcttctctgtataaactgctccttcttcccccagtgcttttgcttatttaattcatgcttatctttcataactcaggttaaatatctagactggattagagaagttttctgtatagtatcctagcatggatacaccaaaatagcatgtatcacactgtattgtaattatatgtatttatttgacttagcattaagtcatcaagatattagaggtcagggcctcattcttttctctcttcctttataatatatgttgttactgtgatacttctttttaataactttaattttaagttcaggagtacatgtgcaggtttgttacataggtgaccttgtatgatgggggtttgttgtacagattatttcatcacccaggaactaagcatagtactcgttagttattttttttttgctcttctccctcctcccaacctcctactctaagtaagctgcagtgtctgttgttcccttctttgtgttcacatgttcttattatttaggtttcacttataagtgagaacatgtggtaatttgttttctgttcttgcattagtttgctaaggataatggcctccagctccatccaagttcctacaaaggacataatctcattcttttttatggctgcatagtatttcatggtgcttatgtaccacattttctttatccagtcttctattgatgggcatttaggttgattccatatctttgctattttgaatagtgctggagtgaacaacgtgtgcatgtgcatgtgtctttatggtacattgatttatattcttttgggtacatacacagtaatgggattgctgggttgaatggtagttatgtttttagctctatgaggaatctgcacactgctttccacaaagcatgaactaatttacactcccaccagcagtgtataagtgtttcctttgctctgaaagtacaccaggatctgtgttttttgatgtttaaataatagccattctgactggtgtgagatggttatctcattatggttttgacttacatttctctaatgatcagtgatattgaacttttttcatatgtttgttggctgcatatatatcttcttctgaaaaatatttgttggctgagcacagtggctcgtgcctgtaatcccagcactttgggaggccgaggtgggtggatcaccagaggtcaggagttcaagaccagcctggtcaacatggtgaaaccccatgtctactaaaaatacaaaaattagccaggcatgatggtgggtgcctgtaatcccagctattcgggaggctgaggcaggagaatcgcttgaactcaggaggcagaagttgcagtgagccaagattgtgccactgcactctagtctgggcgactgagcacaactccatctcaagaaagaaagaaagaaagaaagagagagagagagagagagagagaaagaaagaaagaaggaaagaaaggagggagggacggagggaaggaaggaaggggaaagaaagaaagagaaaggaagcaagggaggacatttgttttcctttgcctactttttttttattattatactttaagttctagggtacatgtgcacaacgtgcaggtttgttacatgtgtatacatgtaccatgttggtgtgctgcacccactgactcgtcatttacattaggtatatctcctaatgctatccctccccactccccccatcccatggcaggccctggtgtgtgatgttccccttcctgtgtccaagtgttcttattgttcaattcctacctatgagtgagaacacgcagtgtttggttttctgtccttgcgatagtttgatgagaatgatggtttccagcttcatccatgtctctacaaaggacgtgaactcatcttttttatcactgcatagtattccatggtgtatatgtaccatattttcttaatccagtctaccattgatggacatttgggttggttccaagtctttgctattgtgaatagtgccgcaataaacatacgtgtgcttgtgtctttatagcagcatgatttgcaatcctttggatatgtacccagtaatgggatggctgggtcaaatggtatttctagttctagatcctgcacaactccatctcaaaaaaaaaaaaaaaaaaaaaaagaaagaaagaaaggaaaataaaagaaaaatatttgttgatgtcctttgcctactttttaatggggctgttttttgtttgtagatttaagttctctatagataatggatgttagaccttgtcagatgcatagtttacaaatattttctcccattgtgtaggttctttgtttactttgtttatagtttcttttgctgtggagaagctctttagtttagttagatcctatttataaatttttgcttttgttgtgattgcttttggcatctttgtcatgaaatctttgccagatcctatgttcagaatgatatttcctaggttattttccagggtttttatggttttgggttttatatttaagtctttattaagatgattgttgtatatggtgtaaagaaggagtctagcttcaatctgtatatggctagccagttatcccagcaccatttattgaatagggagtcctctccccattgcttgtttttgttagctttattgaagattagatggctgcctgataccaaaacctggcagaaaaccaacagaaaaagaaaacttcaggccagtatccctgatgaacattgatgcgaaaatccttgataaaatattggcaaaccgaatccagcagcacgtcaaaaagcttatccaccgcattcaagtcggtttcatccctgggatgcaaggctggttcaacatacacaaatcaattaatgaaatccatcacataaacagaactaaagacaaaaaccgtgtgattatcttaatagaagcagaacaggccttcgataagatttgatatcccttcatgttaaaaactctcaataaactaggtattgatgtcacatatctcaaaataataagagccatttatgacagacccacagtgcatatcatactgaatgggcaaaaactggaagcattacccttgaaaactggcacaagtcaaggatgccctctctcaccactcttattcaacttagtattgaaagttctggccagggcaatcaggcaagagaaaaaaataaagagtattcaaatagaaggagagaaagtcaaattatctctgcttgcaaacaacgtaatcctatacctagaaaaccccatggtctcagcccaaaagctccttaagctgataaacaacttcagcaaagtcttaggatacaaaatcagtgtgcaaaattcacaagcattcctatacaccaaaaatagacgaatgccaaatcatgaatgaactcccatttgcaactgctataaagagaataaaatatctaggaatacagctagcaaggaaagcgaaggacctcttcaggaagaactacaaaccactgctcaaggcagtaagagatgacacaaacaaatggaaaaccttccatgctcatggataggaagaatcaatattgtgaaaatggtcatactgcccaaagtaatttgtagatttataaattcaatgctatttccattaaactaccattgacattcttcacagaactagaaaaagctactttaaaattcgtgtgaaaccaaaaaagagcccgaatagccaagaaaatactaagcaaaaagaacaaagctggaggcatcacactaccctacttcaaactatacacaaggctacagtaaccaaaacagcatagtactggtaaaaaaaaaaaaaaaaaaaaaaaaaaaaaaaaaaaaaaaacagacacatagactaatggaacagcatagagatctcagaaataagaccacacatctccaaccgtctgatcttcaaaaagcctgacaaaaccaagcaatggggaaaggattccctatttaataaatagttctgggaaaactggctagccatatgcagaaaactgaaactggaccccttccttacacattatacaaaaattaactcaagatggattaaagtcttaaatgtaaaacacaaagctataaaaaccctagaagaaaatctaggtaataccattcaagacataggcatggacaaagatttcatgacagaaacatgaaaagcaattgcaacaaaagcaaaaattgacaaatggaatctaattaaactaaaaagcttctgcacagcaaaagaaactatcatcagagtaaacagacagcctacagaatgggagaaaatttttgcaatctatccatctgagaaaggtctaatatccaacatcttcaaggaacttaaacaaatttacaataaaaaaaaacacacagccccatcaaaaagtgggcaaaggacatgaaccaacacttctcaaaagaagacatttatgtggccaacaaacatatgaaaaaaagctcaacatcactgattgttagagaaacgcaaatcaaaaccacaatgagataccatctcatgcctgtcagaatggtgattattaaaaagtcaagaaacaacagatgctggtgaggctgtggagaaataggaactcttttacactattggtgggaatgtaaactagttcaatcattgtggaagacagtgtgatgattcctcaaagatatagaaccagaaaaaccatttgacccaacaatcccattactgggtttatacccaaaacaatataaatcattctattataaagatacatgcaagcgtatgttcattgcagcactattcacaatagcaaaggtagtgaatcaacccaaatgtccatcaatgatagactggataaagaaaatgtggtacatacacaccatggaatactatgcagccataaaaaggaatgagatcatgtcctttgcagggacatggatgaagctggaagccattatcctcagcaaacttacacaggaactcataagtgggaggtgaacaatgagaacacatggacacagggaggggaagaacacacactggggcctgtcgggtgtcggggcagggagagcatcagggtaaatagctaatgcatgcggggcttaatacttaggtgatgggttgataggtgtagcaaaccaccatggcaaacgtttacctatgtaacaaacctgcacatccctcacatgtatcctggaacttaaataatatttaaaaaaaaagaagattagatggtcgtaagtgctcagccttatttctggactctctacactgttccattagtctctttgcttaggattgccttggctattcaggttttttcgtggttccatatgaactttacaatagccttttctagttctgtggagaatgtaattgatagtttgattggaataacatttaatttctaaattgctttgggcagtacggccattttaatgatattgattcttcctcttcatgggcatggaatgtttttctatttgtttgtgttgtctctgatttccttccgcagtgttttgtagttgtcagtatagaggtctttcaactctctggttagctgtattgctaggtttttttttattcattttatggcaattgtgaatgggattgagttcctgatttggctttcagcttggctgctgttggtgtatttttatgtgcaggtacttttacatcccttgggtagcaaggagaatctaaagtttattgaagtttattaatgttattttcttatggaaaagaaaatcatttaaaatgttgaatgagaagtttattcctctgagttaaatacgttgtgatgatcaatttcaactgattcataatgatcacaggtatcactgaatcactgaattttatgatacaaccagtcctgaatgttgaaacaaaatacaattttttagcactttaatagaaccttgaagttggaacaccctaaagatgtttaatacaggtgatttttgtacattgattttgtatcctgaaacttggctgaagttgtttatcaaatgaaggagcttttggactgagaaaatggtgtttactacatgtagaatcatgtcatctgcaaacagggacagtctgacttcctttcttcctatttggatgcctttatttctttctcttgcctgattgctgtggacaagacttccaatactgtgtttaataggagtagtgagagagggcatccttgtcttgtgccagttttcaaggagaatgctcccagcttttacccattcagcatgatgttggctgttggtttgtcatagatggctcttattattttgaggtatgttccttcaatacatagtttattgagcatttttaacagaaagggatgttgaattttatcgatagccttttctgcatctattgagataatcatgtgttttatctttagttctgtttatgtgatgaatcacatttattgatgtgtgcatgttgaaccaactttgcatcacagggatgaagcctacttgatcgtagtggagtaactttttgatgtgctgctggattcagtttgcaagtcttttttttctttttttgaggatttttgcttcagtgctaatcagggatattgatctgaagtttttgttgttgttgtgtctctgccagcttttggtatcaggatgatgctggcatcatagaatgaggagaagactctcctcaaatttttggaatagttccagtagaaatagtaccagctcttctttgtacatttgatagaatttatctgtgaatctttcagttcctgggcttttttgggggtgataggctatttattactgatttaattttggcgctcattattggtctgttcaggggttcagtttcttcctgatttagtcttgggagagtttatatgtccaggaatttatccatctcttcaaagttttctagtttgggtacataaaggtgttcataatagtctctggtggttatttgtgtttctgtgggatcagtgttaacatcccctttgttgcgtctaattgtgtttatttggatcttacctcttttcttctttattaatctagatagcagcctatcttattaattttttcaaagaaccactcctggatttgttaaacttttaaatagtttttcatgtcttatctccttcagttcagctctgattttggttatttcttgtcttctgctagctttggggttggtttgctgaggctggagaattgcttgaacccaggaggcagaggttgcagtgatctgagattgcgccattgcactccagcctgggcgacaagagtgaaacttcatctcaaagaaaaaaaaaatagatttattgagttggatttcaatgttcttccaactttcaatgatcttcattcctatccatattctgaattttatttctgtcatttcagtcatctcatcctggttaagaatccttgctggaaaactctgtggtcatttggaagacagaagatactctggccatttgagttgctcaagttcttgctctggttttttctcatctctgtgtttgagtgttcctttaactgccaggtagattgagtacaggcagtagaattcttttctagatgtctctagagggctgagcctttgtgcagagtctttatttctagctgtcttcttgtctttggtttcacatgggggtatgttaccaaagtattttttggtgttgaagttttgaggtgtgatccagtaggtggcacttaagcataatggtcagttggtaggctcttaatcatgtggctcctctatatttacccacagttgcagccatgctccctcttaatgctctgaaagtgggttcctctcctatttgagtgctggctgcagatcgcagtgtggcactccggggctgcacaccacggttctggagcaatctcagtgtttatgttccttctccaacttggaagcagcagtggttgtggctgagggtctctcacttccccttttcttctggggctctaacccagagagatgtggcgctgcaatctatcagtgcaattgccctgggatggggggcggcactgcctattgaggagcagggggagtcggggggaactgtggaagacagattggcctcccctccttggggtaactgcagcttgctggagatgtggataaggcacttagggtctttgctccttacccattctgaggacaataggggcagtaccactgcagaggcagtggcagaagggcttttggttgcccctgggttctccacgtccaagaattgtttagctgctgtcactggtagtgttcagccagggggttgggtggctgcaatgctggcctgagcagggggctctgcttgttggggagcaggggatcgagggctcaccaggaggaaagaccattctcctctctgtatggtgactgtgtgtgctgcaagctcggatagaatatttattaggtggtcaacaactggttgctgaatgagggctgaggtaaaatcttagagttggaatgtcagagatggtgtatctgaagactctgtaaccttaagggaattggatgattacttgaaattaattcagaattctggatgaaatagtgtttctttttccaatgatttacagtgtaaaattagcagttcttaataatacacagagtagttgtatatttgtccagtgtttttggaaaagtattgtgcatgtatttcagtggcaaaagaatttcttgcacagaaagtaaatgtttagcttcatccatgtcccatatttaatatataatttaatatgcaaacatttatgttgttttctggttacaaatagttgaggataataccaacttcagccctgtcttagttttcttatttaaactctggattagactataactgtagtctctgcctagaagtatatatagctaatataaatctcaagtgcacacagagagtaaatagatgctacaactaaatgcgaaagaagaattaaaatgagtgtagtagctcgcttcagtggtgttttttataaaagtgactctggagaatttgtatgttagagatgtcatttggaaataggaattgggcaaaagagaaattgaggagataccctggaatgaaggcaaatctagtgaaacaactgagtcagaagcagatacattatgacagctcctttcgcttacttcatttcacccctttccccatcccacacatttatgcagttgatttcctgggcaaaattcatttctattctattcagttaatttttttttgttctggttaaagctctaggcatggctgaatcttcagtttcagtaaaacatacctaaataaaattttgcctgtggaaaattgtaatattatttcacacatatgcaatatctaaagtaggcaaaatcatacaaacagaaagtagaaacagaaactagaaagtggttgccaaaagctgggggaagagaggagggagaattagtatgagtatagagtttcagttttgcaagatgaaaaagttctagagatccattgtacgatgctgtgaatacacttaacatttctgaactgtacatttaaaaatgattatgatggaggtcacttccaagatggccgaataggaacgctctggtctacagctcccagcaagatcgatgcagaagatgggtgatttctgcatttccaactgaggtacctggttcatctcattgggactggttggacagtgggtgcagcccacagagggcaagctgaagcagggcagggtgtcgcctcacctgggaagtgcaagcggtcaggggatttctctttcctagccaagggaagctgtgagtcactgtacctggaggagtggtatgctcctgcccaaatactgtgcttttcccatgatctttgcaaccggcagaccaggagatcccctcccatgcctggctcagtgggtcccatgcccacggagccttgctcactgctagcacagcagtctgagatcgacctgggatgcgggagcttggcggcgggaggggcgtccaccattgctgaggcttgagtaggcggttctatgctcacagtgtaagcaaagcggcagggaagctcaaactgggcagagtccaccacatctcagcaaggcctactgcctctctagattccacctctggggacagagcatatctgaacaaaaggcagcagacagcttctccagacttaaacgtccctgcctgacagctctgaagacagcaatggttctcccagcatggcgtttgggctccaagaacagaagcactgcctcctcaagtgggtccctgacccctgtgtagcctgactgggagacacctcccagtaggggctgacagacacctcatacaggcgggtgcctctctgggatgaagcttccagaggaagtatcaggcagcaatatttgctgttctgcagcctccactggtgatacctaggcaaacagggtatggaggggacctccagcaaactgcgaagtaactgcagctgaggggcctgtctgttagaaggaaaactaacaaacagaaaggaatagcatcaacatcaacaagaaggacatccacaccaaaaccctattcgtaggtcccaacatcaatgaccaaaggtagataaaaccacaaagatgtgtagaaaccagagcagaaaggctgaaaattccaaaaaacagaacacctcttctccaaaggaacacaacttctctccagtgagggaacaaaactggatggagaatgaatttgatgaattgacagaagtaggcttcagaaggttgataataacaaacttatctgagctaaaggagcatgttctaacccatcgcaaggaagctaaaaaccttgaaaaaatattacacgaatggctaactagaattaccagtgtagagaagagcttaaatgacttgatggagctggaaagcacactacaagaacttcgcgaagcaaacacaagcttcaatagccgattcgatcaagcagaagaaaggatatcaatgattgaagatcaaattaatgaaataaagcgagaagacaagattagagaaaaaagagtgaaaagaaacgaacaaaacctccaagaaatatgggactacgtgaaaagaccaaatctacatttgactggtgtacctgaaagtgacagggagaatggaaccaagttagaaaacactcttcaggatattatgcaggagaacttccccaacctagcaaggcaggccaacattcaaattcaggaaatacagagaacaccacagagatactcctcaagaagagcaacccgagacacataattatcagattcaccaaggttgaaatgaaggaaaaaatgttaagggcagtgagagagaaaggttgggttacccacaaagggaagccaatcagactaacagtggatctctctgcagaaaccctacaaaccagaagaggctaggggccaatattcaacattcttaaagcaaagaattctcaacctagaatttcatatccagccaaactaagcttcataagtgaaggagaaataaaatgctttacagacaagcaaatgctgagagattttgtcaccaccaggcctgccttacaagagcttctgaaggaagcactaaacatggataggaacaactggtaccagccactgcaaaaacaggccaaattgtaaagaccatcaatgctaagaagaaactgcatcaattaacaggtgaaataaccagctaacatcaaaatgacaggatcaaattcacacataacaatattaaccttaaatgtaaatgggctaaatgccccaattaaaagacacagactggcaaattggatgaagagtcaagactcagtggtatactgtattgaggagactcatctcacgtgcagagacacacatcaggcttgaaataaaggaatggaggaagatctatcaagcaaatgcaaagcaaaaaaaaagcaggggttgcaatcctggtctctgataaaacagactttaaaccaacaaagatcgaaagagacaaggccattacataatggtaaagggatcaattcaacaagaagagctaactatcctaaatatatatgcacccaatacaggagcacccagattcataaagcaagttcttggagacctacaaagagacttagactcccacacaataatagtgggagactttaacaccctactgtcaatattagatcaacaagacagaaaatgagcaaggatatccaggacttgaactcagctctggaccaagtggacctaatagacatctacagaactctccaccctaaatcaacagaatatacattcttctcagcaccaccatacacttattctaaaattgaccacataattggaagtaaaacactcagcaaatataaacgaacagaaatcacaacaaactgtctctcagaccacagtgcaatcaaattagaactcagggttaagaatcacactcaaaaccacacaactacatggaaactgaacaacctgctcctgaatgactactgggtaaataatgaaatgaaggcagaaataaacacgttctttgaaaccaactagaacaaagacacaatgtaccagaatctctgggacacatttaaagcagtgtgtagagggaaatttatagcactaaatgcccacaagagaaagcaggagagatctaaaatcgacatcctaacatcacaattaaaagaactagagaagcaagagcaaacatattcaaaagctagcagaagacgagaaataactaagatcagagcagaactgaaggagatagagacacaaaaaaaaccttcaaaaattaatgaatgcaggagctggttttttgaaaagatcaacaaaatagccctctagcaagactaataaaggataaaagagggaagaatcaaatagatgcaataaaaatgataaaggggatatcaccaccaatcccacagaaatacaaactaccatcagagaatactataaacacctgtatgcaaataaactagaaaatctagaagaagcagataaattcctggacacatacaacctcccaagactaaaccaggaagaagttgaatctctgaatagaccaataacaggttctgaaattgaggcaataattaatagcctaccaaccaaaaaaagtcgaggaccagatggattcacagccgtattctaccagaggtacaaagaggagctggtaccattccttctgaaactattctgatcaatgagaaaaaagggaatcctccctaactcatttatgaggctagcatcatcctgataccaaagcctggcagagacacaacaaaaaaagaaaatttcaggccaatatccctgatgaacattgatgtgaaaatcctcaatacaatactggcaaatcaaaaagcttatccaccacgatcaagtcagcttcatcgctgggatgcaagtctggttcaacatatgcaaatcaataaacaaaatccatcacataaacagaaccaatgacaaaaaccacatgattatctcaatagatgcagaaaaggccttcaacaatattcaacagcctttcatgctaaaaactctcaataaactagatattgatggaacatatctcaacataataagagctatttatgacaaacccatagccaatatcatactgaatgggcaaaaactggaagcattccctttgaaaaccagcacaagacaaggatgccctctttcaccacttcgattcaacctagtattggaagttctggccagggccatcaagcaagagaaagcaataaggggtattcaagtaggaagagaggaattcaaattgtctctgtttgcagatgacatgattgtatatttagaaaaccccatcatctcagccccaaatttccttaagctgataagcaacttcagcaaagtctcaggatacaaaatcaatgtgcaaaaatcatgagcattcctatacaccaataacagacaaacacagagccatgagtgaactcctattcacaactgctactcagagaataaatacctaggaatacaacttacaagggacgtgaaggacctcttcaaggagaactacaaaccactgctcaaggaaataatagaggacacaaacaagtggaaaaacattccatgctcatggataggaagaataaatatcatgaaaatggccttactgcccaaagtaatttatagattcaatgctatccccatcaagctgccactgactttcttcacagaattagaaaaaactgctttaaatttcatatggaaccaaaaaagagcctgcataaccaatacagtcctgggcaagaagaacaaagctggaggcatcacactacctgacttcaaactttactacaaggctacaataaccaaaacagcatggtactggtaccaaaacagatatatagaccaatggaacagaacggaggcctcagaaataacaccacacatctaccaccatctgatctttgacaaaactgacacacacaagcaatagggaaaagattccctatttaataaatagtgttgggaaaactgggtagccatatgcagaaaactgaaactggaccccttccttacgccttatacaaaaatcaactcaagatggatcaaagacttaaatgtaagacctaggactgtaaaaatcctagaagaaaacctaggcaatacaattcaggacataggcatgggcaaatacttcatgtctaaaacaccaaaagcaatggtaacaaaagccaaaattgacaaattggatctagttgaactgaagggcttctgcacagcaaaagaaactattatcagagtgaacaggcaacctacagaatgagagaaattttttgcaatatgtctatctgacaaagggctaatatccagaatctacaaagaacttaaacaaatttacaagaaaaaagcaaacaaccccatcaaaaaatgggcaaaggatatggacagacacttctcaaaagaagacatttatgcagccaacagacatatgaaaaaatgctcattataactggtcattagagaaatgcaaatcaaaaccacaatgagataccatctcactccagttagaaaggcaatcattagaaagtcaggaaacaacagatgctggagaggttgtggaaaaataggaatgcttttacactattgttgggagtgtaaattagttcaaccattgtggaagacagtgtggcgattccttaaggatctagaactagaaataccatttgacccagctttcccattactgagtgtataccaaaaggattatacatcattctacgataaagacacatgcacacgtatgtttattgctgcactattcacaatggcaaagacttggaaccaacccaaatgtccatcaatgatagactggattaagaaaatgtggcacatatatactctggaatactacgcagccataaaaaatgatgagttcatgttctttgcagggacatggatgaagctagaaaccatcattctcagcaaactatcgcaagatcagaaaaccaaacaccgcatgttctcactcctaagtgggagttgaacaatgggagcacatggacacagggaggggaatatcaaacaccgggacctgtggtgggtgtggagctaggggagggataacattaggagaaatacctaatgtaggtgacaggttgatgggtgcagcaaaccaccatggcttgtgtatacctatgtaacaaaactgcatgttctgcacatgtaacccagaacttcaagtataattttaaaaaaagattatgatgataagattaatgttacatatttttaccataataaaaacgtttttagtatttgtcgatgaaaattttcataaaaacagtttttaaaggattgttgaaatatttagtgttatatactaacctgttttattatttttacagttcatataaagtgcttggactaatacctatagtaagtgcttaataatatcatgattgaatatgtaacatttactttccaatgcaatttgatgctttctttttaagctgcttttacggaaagggtacttgcactgtaactcaaaatcatctgatgtagttcatgagggctatttatagtcatagagtactgtgaggctacaaggaaaattttaatataaatatacattcttcaggaatattttatgctttgtaacaactcattttccttgaaatagccagcctgctcctgtgtttatcacttctttgtgtttttctcttaaatgttataaatgcaaaagaattttctttcaagtatgccttttatatactgctgagcactcataaatattaggtattaaaaaggatattttcttctaatttagatattatgagaaggtaacttaatttgaactcattgtttctcaatatttaaaaatatctctttaagtgtaagaatgaatacttgatatgtattcaaatgttatcatggatttgaatcttcaggaattgaagaatgattttaactattgacatcaagggagaaaaatagaaaagttaaagaagcattattttttcttattttgactatgacacatcaaaatacccacctgatctcttccatcaatgttaataacgagtcacagctagtacatttgttagttatgtaccaagctcagttctaaatgctttaaattatttttattctcaaaacaactatgagatacttacaattatttatcttaatttttcagggtaagaaaacagaggcacagagtaacttattatagccacccaatcagaaagtgacagtctgagattgaaatccagactctctggctccagagcccatacttttaatcagtgcacgacactcctgtcttatttaaagaaatcttattcagatatgtcaagtgcaaacaggatggcatctctagtacattctgaattcggaaatcttataagcaccacttttggtataatgtgaaaatagaaatgacaatgactgtatgcttttggctgaattttaaacatgaagataagccgtatccgaacaactgaaaaaacaactatggaaaactcggttattcagttgaaaattatgcattcgcctcttttcctaaacataacttccctaaaaaagacaaaacagtttgataatcttttgtcgtatttgaaattcaaacaaataggaaatgtgtgtgaattcaatagaagtttcattcaatggcattccaaatcttgctatttcttgtacacttcaggtgcactcccacctcagggtctttgcttttgctgttctcttgaacctgaacactcctctaggtgtctccatgcctttctttatccctgtctcctcttctgcaagtctttactaacttgtcaccttctcagtgaagacttcccttcaatatttgcatatcttacagtggctttctccttcttccttctctacagcatgtatcaccttataacatggtacatagtttacttattcttatttattatctgtcttcagcaagtacaataaaaactctataaaagcagggattttttatgtctattttgtttcctgcaatatccccagagtctgattgcaagtaagcactcactataatttgttaaatgtattcactttatctctggtttcaaagcagtttacattaagatttatctgacagtctagtagaattaaagcttttatgctttttgatgcaggcaaaagaataaaagagagaaaaaccaatccattttgttttgaacagtccctaatacacatacattttcaataactgttaaatatatattatactctgctggttaaggttgtcgtattaatcagttttgtgatatattatacccccattcacttattttcagtctaatgttaagaaaagacaaaacgggaaaacagatcatcatatgaaaaagatacctgcactgatatgtttatcacagtgctattcacaatggcaaaatcatagactcaatctaagtgtccatcaacagatgattggatttttaaatgtgataaatatataccatggaatactactcagagagattatttacttcttctttcctatttggatgccttttatttctttttattgcctggttgatctggctaggacttgcagtactatgttggataggagtggggagagtgagcatcattgtcttgttcctgatcttaaggagaatgcttccaggttttgtcagtttaatatgatgttggctgtaagtttgtcttagatggctcttattatttttagatatgttcattctatgcctagtttgttgaggttttttataatgaagggatgttggattttattgaaaggttttctgcatctattgagatgatcctatggtttttgtttttaaatctgtttatgtattccaagaataaatccttcttgatcatgatgtattaactttttatgtgctgctggatttggtttgctagtattttgtcgagcatttttgcatatgtgcttatcagtggcattggcctgtagttttctctttttttgttgtgtctttgccaggttttggtagaagggtgatgctggcttcacagaatgagttagggaggagtccctcctccttgattttttttggggtaatttcagtggaatatggaccagcttttctttgtacatctggtagaatttgactgtgaatccattttctgggtttttgggggatttttttggttggtagggtttttattactaattcaattttggaagttaatatgttcttattagggttgcaactttttcctgattcaatcttgggaagttgtgtgtttccaggaatttatccattttctctagattttctagttcatgtgcatagaggtgttcataatagtctctgagaatcttctgtgtttctgtggaattggttgcaacatcacctttgttgtttttgattgtgcgtatttggttcttcttgctttttccttgttaatctagctagcagtctattgatcttgttccctctttcaaagaaccaacttttgatgtcattgattctttgtgcagaattttgggtctcaatttcattcacttttgctctgattttagttatttattttcttctactagctttaggtttagtttgttcttgttcctctagttcctctaggcatgatgttagattgttaatttgagatctttccaaattttgatgtggcaagattagggaaattttcttgaattattccctcaaatctatttttcaggttgtttactttttctccttttctctcaggaatgccagtaattcctagatttggttgctttatataatcgcatatttctttaagattttgttaatgttttggggttttttgtttgtttgtttttgtttttgttttttattttaagttctgggatacatgtgcagaacgtgcaggtttgttacacaggtatacatgtgccatggtggtttgctgcacccatcaacctatcacctagattttaagctctggatgcattaggtatttgtcctaatgctctccctctcctttccccccaccccatgagaggtcctggtgtgtgatgttaccctccctgtgtccatgtgttctcattgttcatttcccacttatgagtgagaaaatgcagtgtttggttttctgttcctgtgttagtttgctgagaaggatggtttccagcttcatccatgcccctgcaaaggacatgaactcatcatttttttttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccacctcggcctcccaaagtgctgggattacaggcttgagccaccgcgcccggccgaactcatcattttttatggctgcatagtaatccatgttgtatatgtgccacattttctttacccagtctatcattgatggacatttgggttggttccatatctttgctattgtgaatagtgctgcagcaaacatacatgtgcatgtgtctttatagtagaatgatttatagtcctttggatatatacccagtaatgggattgctgggtcaaatggtatttctggttctagatccttgaggaatcgtcacactgttttccacaatgattgaactaacttatactcccaccagcagtataaagtgttcctatttctccacatcctctccaacgtctgctatttcctgactttttaatgatcgccattctaactggagtgagatgatatctcattgtggttttgatttgcatttctctaatgaccagtgatgatgagcttttttcatgtttgttggccacataaatgtcttcttttgagaagtgtctgttcatatccttcacccactttttgatgagattgtttgttttttcttgtaagtttgtttaagttctttgtagattctggatattagccctttgtcagatggatagattgcaaaaattttctcctattctgtaggttgcctgttcactctgatgatagtttcttttgctgtgcagaagcccttcagtttaattagatctcatttgtcaattttgctttcattgcaattgcttttggtgctttagtcgtgaattctttgcctatgcctgtgtcctgaatgttattgcctaggttttcttctagagtttttatggttttaaggtttacatttatcttttttctttatttgtctgccttgattagttcaaaagactagtcatcaagttctgaaattccttcttctatatggtctagtctattgatgaaactttcaattctatttagaaattccttaagtgaggttttcaattccagaagctctgattgattttttttttttaagttgtattatctcttcctgcatttcctggattttcttacaagtttctttgtgctgagtgagaacattcagtgtttggttttctgtttttttctctctttttttttttctcttttttgttttcttttctttttttttttttttttttttttttttttggagacagagtctcagtctgtcacccaggctcgagtgcagtggcacaatgttggctcactgcaacttctgtttcccaggttcaggtgattctcatgcctcagcctcccgagtagctggaattatagactcccaccaccacactcggctaattgttgtacttttagtagagatggggtttcaccatcttggccaggctggtctcaaactcccgacctcaagtgatgggcccacacctgcctcccaaagtgctgggattacaggtgtaagccactgtgcctggccggaagtttgtgttgattttcagccttgccttgacattttcagtaagccctgtagtaaaaattagtttagataatgtaagaggatatagaaagagtacctaataagtaatgttgttagatgagttatcagagatgatgtctcacttacctcttctggcttttatagaacgaatggtttagtagtaattgttgttttttaagtgccaagccacatgaaattaagattagaggcagatttttgctcactttattcattttcattcactatagacccatgatgttttgaaaggttatattaaacatccatgaaattttaccatggcataagtcttcctaaatctgcatatatatttgaaaagctttgaagtattttttcacaagggaatggtttattttcaaagacttgtatagctattctaaacaccttttaatgtgccagatatatgatcttttcttagcatgctcttcaatatttttgtaaagttagattcagaactgcaaaacaatatagtagacttcattttatttgtgagatggttgttaaagcaagttgacaataataaaaatgattttattagtcctcaacagggattaaatattctcccttttaatgtcaattaatttatttcttcaacaaatattgactatttgccatatggcaggttttgttctaggcactgcagatacaaatatattattatgagtataatcagactcacccacacagttatatcaactaatacctaattatatgttcatggtgagacacaggctataaaattctgacacatttccacctgtttagctactgtagttgttggatcaattcttttaattttatgggcagcattttttgtttatttaccatcttgccaaaacatgggcagcaaaaggagcagttagtggagacaaaatgtgaaatataagtagctccaaaagagaagtttagcagatattgcaagtaagaagttaattcatttaaggagaaacaaatactaaccctaagttcgttttctctccagttttagcctatcaattatatacttgtttttaaaaaatgtttattggttgcctcagagtttatagtatacatttataacaaatccaaatccacttttaaataatagtatgctgcttcatgaatactgcaggtaccatataacagagtatttccagttcttccctgctggcccttgtcacattgctttcatttgtttcacttgtccataaactataattatggaatatattgttgttgttattattttttaaaaaaatggttgttaggtcagttgagaaaaagaaaaatattttattttaccttaatgtatttcttctctaatgctcttcctttctttatgtggatctaatatccgacataattcctgacatatcattttctttcttatcttttaatattactgcaaggcaggtctactgacaagaaatgtcttcatttttgtctgagaaagtctttatttctcctacagtatatcagtgtattacatgatgcagaattgtaggttggtggggtttcttttcaaaacttgaaatatttaaccccacactcttcttgcttgtgtggtttctgaggaggagtttcatgtaatccttattcgtcttcctgtggagatagttttcttcaaactttcaagattttcttcttctctttaattttctacacttaactctgatatgcctatgtgtagataatttggtatttatacagcatgatgttctttgagcttcctggatctgtgccttggtttctgtcattaattttgtaaaattctcagccattattacttcaaatacttacttcttccttctctttcttgtattctcattgtgattattttacaacttttgtaattgtcacacagttcttggctattctgttatttttttctctctctcttttttctctttgcatttcagttttggaagtttctgttgacgtttctttgagcacacaaatgctttccttgtggtgtctggtctactgatgagcccatcaaagccagtctttatttctggtactgttactttgacttctatcattacctttcgattcttagagtttctattgctctgcttagatcacttagcatattaatcatagttatttcaaattcccagtctgtttattccaaaatttccactatatctgaatctcattctgatgcttgctttgtgttttccgactatatttcttgccttttaggatgccttgtaattttgttgacaattagacctgctatatggggtaaaaggaacttagggagatatgcctttaatatgctgggttttgtttatctggctaggagttaagctgtgtttgatgtttgctgtagctgtagtattagaggctaaaagttcttcagtgtcattgtttttgtctaacctcttgtctttggatttttccagcgtctccttaaatagactttgaggctagaatttgttttagctgtaatctgctgttattataccagagccctgttggggcagtgatagggttgggggggaaggggttgtttactatagtcctatgattggctgtcagttttttagtgagcctgagttttgagtattttctttcctccatttgaaagcccagggaggactgtagttggatatttcccttcccccagtttaggtaggctttggtgaaccccattaagttaggatctggtaaaatagtttctcttgagggtaagtcctattaagaagaacagaatgctctggcattttaaaaaatgataaataggcttggcatagtggctcatgcctgtaattctggtgcttttggaggctgaggtgggaggattgcctgagcccaggagttcaagaccagcctgggcaatgtaggaggaccctcatatctacaagaaattaaaaaaaaaaagactctagtcaggcaccaggcgtggtggcaagcatccataatcacagttagttgagaggctgagacaggaggatcacttgagcccaggagttctaggttacagtgagctatgactgtgcccctgcactctagcctgggcgacagagcaagagctcctctctaaaaataaaataaacaatcaaattttttaaatggttactattctctccccgcttgctggaagcacaagggggacttttcctcaaatcttcagtcaaaacctaatgaagctcctggagataaaacttatgaaagtgtggaggcccccataagactggacctcctagtagtttttaatttgcaagttagtatacactgagtctccagcaattcattaattacagtttaaagctttgctgctgatactggctcttgctgcacggttctgctcctgggcttctactcaaagccatgattctctgtatttgcctgtctttctagttttgggggcaacctaatgcatcatgatggattgagttgttaacgtgtagtttgttcagcatttttcttgtgagatgggagtaacagtttccaagctctttacatgtaagaaccagaaactctgaccctagattcagaattctagggttcaaatggcaggaggtccaagaagataagcaagctttctggcacactgtgttgaattccaaatattattattattattattattattattttgagatacagtctcactatcgcccaagctggagtgcaatggtgcgatctcagctcactgcaacctctacctcccaggttcaagcgattctcctgcctcagcctcccgtgtagctgcgattacagccatgtgccaccacgctaggataatttttgtatttttggtagtgacggggtttcaccatgttggccaggctggcctcgaactcctgacctcaagtgatctgcctgcctcagcctcccaaagtgctgggattacaggcgtaaaccaccacacctggccccaaatcttatttttgttcttagttttagtttgataatctaagatatagattagaatgtactgtatgaatcctttccccatgttttgttaccttaaataatatggtattctaactattctgccataatcctgagtctcgtcttccttggcctgtggctgtccatgacacagagccaacatacttgtagtggacattggttttcagttgtgttttctgctaatgtagagttactggttagttctaattaaactgggggtgctgaggctaggcctgctgaggaatttatacccagattcaaaaggcattgagtttcatgttataaaagaagttgtgtagttaaggagtcagcattacacaacttatagacagtgaatatgagaatgtaaatattctctttataaaagacaatataatggatatgtaagtacccaggcttgttttgtttggttcacaaaatatattaaaagttttatttaagagaatgtttattgctgttttttcttctaaagaaatgccatcttatacattcatcaattgttaaatatttctttgaggtgggatgcagtttacttcaatacagatggctgtctgtcttaagacaatatgctaaaattcagttttaaaatcttaaccacttaacagtttattgcagagctagggaactgtagtgtagcatataagttatttgtctctttcttataacaatttgttatcagtgacagaactttttgtaagtaaatcagtgataattctaagtgaccagggaagctgaaactgtgattattaggttatcttaataaccaataataaaaattaagatcgttctatgacctttaaaattttttttgtcaagacattaaaaacttcttaatgttggttataagtatattgggaaatgaaaaaatagtaaaactaatttttttttagtatactgtaattgtaaacatcagaaacattcagaattaaagttttatttctttgtaaaaacttttcaagagtagtttgaacacttcttgccttgttttcattgtatggagcaagaggttttctatgccttggcaaattatcatactcctttccaaatgtggataagctgtccacttttgatctgtgcatttttaatgtcatggaatatctgagaagtcttttaatgtggaggtctttgctggctggcatcactgctcctgggacattgtcatgctttgcatcacaactactttcctgagtttataaagttttcctgggtatggatttcacagcagaatctttatctgcaccagcagttcaccagctagcttaacattatcaattcatgctgacttttgaaacaaagaaatcagcctttactggaggttagagattcatcttcagtcttcttgtaattactgctttcaattactgtattcaaagttggttcttggacctaaatgctagccaactgcatcgtgaatttgttttattacagagtcttcaatgcaaaaaagtcggtgcttcgtttcaaccgtaagtgactttctgtatgttgtgcagattaaactaaaaaatgttggccggggcgcggtggctgacacctataattccagcagttccggagaccgagacgggcagatcacgaggtcagaagatcgcgaccatcctggctaacatggtgaaaccccgtctctactaaagatacaaaaaaattagctgggcgtggtggtgtgcacctgtagtcccagctactcctgaggctgaggcagaatggcgtgaacccgggaggcggaggttgcagtgagccgagatcgcgccactgcactccagcctgggcgacagagcaagactccatcacaaaaaaaaaaaaaaaaaaaaaaaaaaggccgggcgccgtggctcacaccggtaatcccagcactttgggaggccgaggcgggcggatcacgaggtcaggagatcgagaccatcctggctaacacggtgaaaccccgtctctactaaaaatacaaaaaaattagccaggcgtggtggcggcgcctgtagtcctagctacttgggaggctgaggcaggagaatggcatgaacccgggaggcggagcttgcagtgagccaagatcgcgccactgcactccagcctgggcgacagagcaagactccatcaaaaaaaaaaaaaaaaaaaaagatcaaaactattttacctaattttcaaaatattcactagacttttcaatatggttcggtttatactataacctcatgtagtgctagtttattattattattattattattatttgtttgtttctttgtttgagactgagtctcactctgtcccccaggctggagtgcagtagcacgatctctgctcacggcaacctccagctcccaggttccagcgattctcctgcctcagcctcccatgtagctgggattactggcgcctggcaccacacctggctaatttttgtatttttagtagagacagggtttcaccgtgttggccaggctggtcttgaactccttacctcctgtgatccgcccacctcggccttccaaagtgctgggattgcagacgtaagccactgagcccagcctgtttttgtcctatcttaacattgctgttaccattttaaaatcttctagtcacatctaatttcacttccagtgtcaattttcatttcttcattgtactttcctggggcatttttggaaatttcctcttttgattaaatatttttgtaaaatatcactgggagtttattacttggagaaacacaattacatactttgctgtctgtgcatgagccgactagcagaaaagaagtgacgtgatttgtcactgatcgtgatgtgcatctcttatttgtgtagtgatttgtaaatagcagcaagcacatctggtttggtatattttccatatcagatttcaaaatgtaaatcgattgcttacttgttggttttaagtcccaatatatgtcttatactctgaaataaacacttctagatgtattttatgttgatgcttagtggtagtttaaatggccttctatcctggaattaaactacaaagattctcacttatattcaacaaaaataatggatactaaatagaagaactgaaacaaccttttatgaatcctttgaaaaaaagttttttagtaaatttctgctaaattaactattagatataggcttatctataatatactatttatgtgtttgcataaagagaaattactaccaaaagatcaaatccttcaattttttttaatgttccctggagttgaagagatggagcatttttataagctcctgtacttcactttttccatctatccactgcttaacttcaggcagtatttttatcaaacatgttctttttctccattatcatgacccaagatacatgttccatttattctttttaatttaaccatgggcatgaacacttatcaatatagtaagagaagtctgaatggaaattttaaaaatcaggtagcaagcataaaatagtttcatattattcttctccatatttcattattagcagagcattaggtgacaatatttgagtattagcacatcagaggaaaggagccagattttggaaaggtagcagtgaagctgagggatacgagtttgaaaacagaagggattaatagggccaaacatagtgaatcaagcaagataagcatttaacagtttccactgaaaactcacttttacactgtaaaagtaggatacttttacatgaaggagttaaaaggcacttaaccaaataactgaaaatgtcagtggagcacactggtgagtatagttagaaaggcttggcagaataagacttaactgaagcagcagagatggtgtcatataacgttcatttcataacacataacatgaagtagattcttgtcagctgacataaaatcttctttctaaaatggtaatgattttacctgatttgtcactgtaaattcaatcatctgaatctattagtataattatatttcaggagtttaaaggaaaatcaacctcttttttgtatgtagaaaatacttcatcatagaagaaaactttctttttaatcatggaatgttgttttagttcatggaataagacttaagtttaggatttttgttgaaacgtaagtgttgagttgaggtggttgattgttttagaaccttttaaaaacttcttaaaactttatttaaaagtttttaaaaacaagtcttaaaagaacttggagagcagtgtttaaaccaaggttcttatgaagccaacctagaaaaaataacattcctgtatatttttagtcaattgtttatctttattgttttacaaaagatttgctcatagttacattaaaaccttcttattttatgtcttcttaaaagggacaatttgaaattctcattttagaaactagtattacagctttatacagtgtctttttttttttttttttttttgaggcagagtctcattctgtcacccaggctggagtgcagtggcaccatgttggctcactgcagcctccatctcctgggttcaagcaattcttctgcctcagcctcccgagtagctgggattacaggtgcccaccaccatgcccggctaatttttttatatttttagtagagacgaggtttcaccatactggccaggctggtcttgaactcctgacttcaggtgatccacctgcctcagcctcccaaagtgctgggattataggcgtgagctaccacgcctggcccttttgcctatattctaaggagctattagttgcttttagagaattagtttacatgtaaagattaattccataaatacacatataaatatcaatataaatgtatacgcatataaatattatctgcatatatacctgctaagtctataaagagagactaattctgtgaatgtgagatgtatgtcctcagttttagaggaagctttatcttgcatttagttgtttgaatctaatccttggacttagggggtaagtagctgactgcattgcctttccaatcacccgtaaaagaaaaaaagcacagctttcctgaagtatagaaccgtgggaatatttgcaagcataatatgtgagtctccctgactttaacctggatatcctttgtttcaacttctctttcatatggtttttaaaaatattatatacctcaattttaaggcctagaatgttgtttttagatacaattaaagtatgttacacacaaattatcttctgtaacacttgaaattggtatctttaaaaacttaacacacaccaatatggaaattcaagatagcacattatatttcagaaaaaaaaatgcttctctgttaggatttcatgagagtgtttaggcttttttgtgtctattgttttacagtaaatttttatagatttgtttatttggtagccctgttaaggatatttcatagtcatatctctaggatcctttaatatatcaggtgagttggtttaatgatgtccacattttaaaacgggtacaaaaaatagaatgagtagtatttaacagcaaaacagggtgactatagtcacctgtgcattttgtgcatgaaaacttgaaatgcaaaattgtgcagttttaaataactaagagagtataattggattgtttgtaacacgaaggataaatgcttgaggggatggatatctcatcttccatgatgtgattattatgcattgcatgcctgtgtcaaaatatctcatgtaccccataaatatatacacctactatgtacccacaattttttaaaaaaagtaataaaaaataatatgttgcccttagtgtcttacatttttattatgaaattgaatatttttacttgaagttataacttgctatgtctttacattccttggtatgtggagaatttggaatgtcccatacttaatattttgatttgccaccaagattgctctgaatctgtattcgcctttattgccaagtttcttcttaactgggagtttgaaaatataaactttaaccattttttctggataccacagaacccacaacgtattactgttatcagtttacagaaaaacacaatgactaatacgtgactaatgactgatgtagttgatatgagaaagactaatcatatcaatgactaatataggttcatatgagaaagaggaatgggaacctctttattccacatatgcttattattcaacattgccaaatttcaaaaaaccaattgcagcctccatgtgactcagttgtagccacattctccccttttccattaaactgccacacagctcttttcacttatgacctgatagagccaccccaggaaaagagaaaatggttttcagacaatttgtgtctgtaaattgtcatttaacttactttgtttttaaatttttatccctttcgaattttctggagctttgtgaagttagttactacttaataatcctatctttgaaaagagttagtgctgtatcagcaagtaatctgaggtgggaatagtcccaaattatgggcccattcgtcttgagaccttttcattttatattaccggaaagtaaaagcccctttcctgacattgtagtgtcagttttctagttagattttttttttttttttactccttcacctagccacaactttacttcatttgaaattaactaaatttgtttggctttgattataaatttatcttgtttgtttaaattttcttctcccaaaatgacattcttatgttatttattagtgtggaacagttatgaatcctttcctttttattataaactgttgaacaacttagaacttttcttactctgttttaagaattgcatgtgtagtcttttcagtaatcttttcaactcctgtggactgtgaaaaggtattttctagcaaaataagaatgagaaattccacatattatgcatcctcttctcagagattattagtttatagaagcatgttagggttcagagaacttgaatgctgagtgaagaaacccctctgttttgctttgccaagtgtttccaaaatcagttagtcaggattgctatttttgcaaaatcccagttaatgccctccattagcgtgccactactgcatgcagtagtgtgcagttctgagaaacccagtttctcagctgtttctaatcactataggatatggtgatcacttttgtcagaggaaagtataataattaaataggatttgtcctatagaaatatcaaattttttttttatttttgagaaggcgttagggagaaaagagatttttatgtggagtagatcgtttaacaagaaatctgggacctgatttgttgtgcagtttagctaacaacttcaaaaagaaaaggaatgaagagtggcaatttagaacatatagaatgtaaaagcagatatggtctgataagaaatatgttttttaaatgtataatgtcttagaaaaatcaaataggaatttattacacaaatcaactgaagtatggtaatatcattcattttacttacacgagtacaggtcaccccaccccttgctgcagcaccattttttgatgtactatgttttttcccattagatggattaaagaatgagatatatgatatatttgtaaaaaagcattacagagacctataaatccagacctctgggtctatatttcacaagaagttttagagcaatacagaggttatttttcttgctatggagtaatacagaattttggaatgagacaaagatatttttagaagttaatgaagacttttatttttataaacacctacatattccagaagtttacatttggacagcctcctagtttaaaaactgaagataggcactagaatctcattgtaataaatccgtttgggtcattttggaagacttaatcctcttccaaattctcattaacctagtctccgaggacaagagcacaaccagaatgcgttagttactaacttctttcccaatctctttttatagctagattcatttaggcctgtaattatttcaaattttattaaattattgatataaaaagggggaacagttgggtatatctgaaaaaatgcatttcaggagggaaagccaattagacaatttagaaaactggctatattttgacttatgcattgtcttagtaatgttttatgttattgtttaactacttcataatacctccactaaagtaaactaacagaacagtctcaagatttgtgtattatgaaatccaaatatggtgtactttatgatggaaaaggcatataatcaaagcctcccaagaatatttcttaaatgtcacaattaatatcccttaatgttacttgcatatatactttattatatatgtcttgtctatgtattatatacttgcatgtacagtttattatagaaaaaaaacaaacataaatgatagaggaacaagatttagaaaataaatgaatcaataactgaaaggtaattagactgaaactgtttattagcactgagtatttcatttgggatcatactacctttacccacatactatagtaacacttacctaaatatacacagatatctaaggaaaggaccaataaatattcctgggtcattgcttactcaatcatggtttaatataccaccaagcttactcgtggctcttgtgataaacaacaaaatcccactgagcaaacaataactaatatttagtgaatccttattatgtgccagagtttattccaaaggcttgtattaatttaacctctcaaaagtgtgagctggatacagtggctcatgcctataacccccgcactttgggaggccgaggctggcagattgcttgagctcaggagttcaagaccagcctgggcaacatagtgaaaccccatctctaccaaaaatacaataataataataataataataataataataataacggggcatggtgatgcgcgcctgtggtcccagatacttatggggctaaggctggaggatcgcttgagcccgggaggtggagactgcagtgagctgagattgtaccattgcactccagcctgggtgacaaagtgagactctgtctcgaaaaagtttaatctccagtactagaaagcagatcagtgactttctggggcccgtgctggactggggattgactgagttgggccacaagagaacttttgggaatgttgtgaatattctataccttacctttataaaggtgagacataagatacatttatcggaacttaccctaattgtatacttaataggagtacttttattgtatgtaaataacacatcatttaagttaatttaaaagaaagcaaggcacagaaaaagtcttaccctgaaataaagctactataataccttattgtttatctaggcaactttatagattttattatcaatatttagattttccaggcattttctttataggatttgtcctatataaatatcaatttttttatttttgagaaggccttaggcagaaaagagatgagtagatcatttaacaagaaatctgggacctgatctgttctgcagttcagctaacaacttcaaaaagaaaaggaatgaaaagtggcaatttagaacatatagaatgtaaaagcagatgtattttctttatagagcatgccaccttttttcagtttcattattcagtataaactctaatggagtatgaaaaaaagaagaatgtgacacttgaattgatcacttaggctgtttaagtgaggagaatgttggacctattggcttttaataaatgactatcaaatatcatatatctgtgttcttgttctgctaatatttttcaatggattgtcaatggatatcacatatacagaatatctatgtttatatataaaaggaaaacaatatatgagagatttattcagtatttcttttgaccatattagtctattagtatcagaagtgagtggaattctaaggcatttgcaaacatgaaccataattatctgtttcagaagttacttatgtttcttgcacatctctggaaaacagttggaccaaaatactcctatctagaaaatgcaaagtttatacatcttgtcatgtatgcctccttaagagacatagttttatttagacatttttcatcagagaggctaaaactgttctcctctgactgggctgcactgagagcaaaattatcagatttttatttcctctttgactaatcaggttactgacagggtcagactttttcaaaacctgagtattttgcttagtagtaagtggcctggggttgttcatttgatctctgttgagtatactttttccagttctttttattgatttagaattgcacaaggaattcttagaagggcagtggatagacttgagattttaacccaaaaggctcaatttgtttgtaataatctgctggattattgggttctttttagtaagtattgttttaggtgcagaaatttcttgtgttgttttatatttctcagtgataccagaataaaattattagtttaaaaataataaattattgagcttccacacatccctatgttagtaaactcagtaaactaccaaaattacccttcctaaaagataaactacctacaatatagctttgttaatcagattatggaaatttgtcaattttgcagagacgaagttgcattcttgaaaatttaggctgaaatataagcatacttgttaattcaaaaaaagttccagagtcattcataaatggtttaatgtgaaaggaagtcaaaacaattattagaactacatagacggcatcatgttttgtccctaaaaattgttaggaatgaagcagagactctgccagtagaattctaattttagtagtatgtcagattaaatcaactaattattgcactattttaagggtgggtagagattggcatgcaggtaattgcacccataccggtgccaatggaagcaattctaaaacagtttgggcttaaatatcttcaataccactggacgtatgatggcttagttcatgatgtcctcagtatatgagaggaaacgagcttatttataaaacagggaacataatattttaattagtatttaattttgattagtgttagacaataatactggcatttaattagtattagacaataatactgccataagaaactattaatttggaattataaatagacataactcaggacatgttattgataagtgagtgctaattatggaagatggttagtattcagactttgacattattccagatgattgtgccagagaagctagatttgtactttacattggatttgtgctttcagctatttctaaatgtaccattctgattattcttgaataatatgcatggatttccattactctgtggcctaagaatggatattggctttcaaagtttttattttaagcagttatacatgcaaagtcctttttaaatttttcttttgattttgaggtctcactataaaatagtttgatttttttaaaaacgaagatctgaatgattgttatctttttctaagtagtattctggaacgctgtacaatgataactgctaatgtttataatgcttttggaatgcctctttgaagattatgtatagagcctacaagcaattattttaagtatcataatggtgacatttcaggaaaaatcctttgaagtggatattgacttttgagaataatcagaatgagaatatgatccaattagtattcatattcaattatagttcacaaaatacttgttcaaatctgttattgccaatgaggaaaaaggatagaaagttacctgcaagatataactatcaagcaataaaattgattttaaattcaccttgtagttgaaagtagttgagcagttgcagcatcattgcataaatatatggtctgaaagtgtgcacagaaagataaataacattcatattcatttgaatacaggcatacctcaaagatattgcagctttggttccagacaaccacaataaaacaaatactacaataaagcaagtcacatgaattttttggtttctcagtgaaaagttgtgtttaaggccaggcccggtgactcatacctgtaatcccagcactttgggaggctaaggcgggtgaatagtttgagctgaggagtttgagactagcctgggcaatgtagtgagcccttgtctctacaaaacattaaaagaaaaattagccaggcatggtggcacactcctgtggtcccagccactagggaggctgaaatgggaaaattacttgaccctgggatgttgaggctgctgtgagttgtgatcatgccactgcactccagtctggatgatggagtgagaccctgtctccaaaaaataaaataaaataaaataaaactcacttgtgtttacactatactgtaggatactaagtatgcaatagcattatgtttaaaaaatttgtctaccttaattaagaaataactttattgctattgaatgttaatgatcatctgagccttcagagagtcataatctttttgctggtggagggtcttgctttgatgttgatagctgctgactgattacaatggtggttactgaaggttgggtgaggtggtaatttctgaaaataggacagtaatggagtttgcaacatcaattgactcttcctttcatgagagatctgtctgtagcatgcaatgctatttgacagcattatatccacagtagaacttctttcaatattggagtcaatcctttcaaaccaggttgttcctttatcaactgagtttatgtgatattccaaatctaaatattctaaattgttgtcgtttcaacagtattcatagcatctccaccagaagtaaatttcatctcaaaaaaacactttctttgctcatccagaaaaagcaattcctcagccattcaggttttataatgagattgcagcaattcagtcccatcttcaagctccacttctaattctagttctacttgttatttccaccacatctgcagtgacttcctctgctaacatcttgaacccctcaaagtcatccatgagggttggaattagcttcttccaaactcccattaatgttgatgttttgacctccttccatgaatcacaaatgttcttagggacatctagaatggtaaaccctttccagaggttttcaatttactttgcccaaattcataagaggaattattgtctagggtagcaataactttaggaagtgcattttctatataataagacttgaaagtttaaattgcctctctatgtatgggctgcagaatagatgttgtgttcgcaggcatgaaaacatttttctagtacagctccatcagagctcttcagctgactaggtgcattgccaataagcagcaatattttgaaaggaatctaattttttgagcagtaggtctcattagcagacttaagatattcagtaaaccatgctgtaaacagatatgttgttacccaggctttgttgtttcatttatagagcacagacagagtctatttagcataattcttaagggacctatgtttttcaaaatggtgaatgagcattggcttcagattaatgtcaccagctgcattagaccttaacaagggtgtcagcctattctttgaagctttgaagccagacgttgacttctcctttctagctatgaaagccctagatgccatcatctttctacagaaggctattttgtctccattttaaatctggtctttaatgtaaccaccttcatttatgagcttaggtagatcttctggataacttgctgcagcttctacatcagtactttctgcttcaccttgcaggttatgttatgttatgttatgttatgttatgttatgttatgttatgttatgttatgttatgttatgttatgttatgttatgttatgttatgttatgttgacagctgttttccttaaacttcacggatcagactctgctagcatcaaacttttcttctgcattttctttacctttctcagcctttatagaattgaagagagttagggccttgctatggattaggctttggcttaaggaaatgttgtgactggcttaatctatccagatcactcaaacgttctccctatcaaaagactcccaaaaaaagactttttttgctttcttatcatttatgtggtcactagtgtagcacttttagtttacttcaagaacttttcctttgcattcacaacttggctaactgcttcgtacaacaggtctaacttttgtcctgtctcagctttcaacattcctttctcactaaacttaaccatttcaagcttttgatttaaagagatgtgtgacttttcctttgacttgaacacttaaaggctattgtggggttgttaattggcctaatttcaatagtgttgtgtctcagggaatagggaggtttgaggagaaggagagagtcatgggtgtggccagtcagtggagcagtcagaacatacacaacatttattgcttaagtttgccatcttatatgcaattataatggtaacataaaagatcactgatcacaggtcatcataacacatataataataatgcaaaagtttgaaatattgggagcattaccaaaatgtgacagagacacaaagtgagcacattctgttggaaaaaatggtcccaatagatttgctcaacaagggttgtcacaaatcttcaatttgtaaaaaaatggcagtatcttcaaagtgcagtaaagcaaagcacaataaaatgagatgtgctggtaataaattctgataaacttacctgaaaatattctgtattcttgtagtatgaaataagatagaaggtatcttactacattaccaaaaaggtctgctctaccgtacgtggctattggacttagtccctctggcttttctcttagatggcaacactcactaccatatatttttctggaaccttgggtgttttttaaccttcctggtcattagttattgctaaatcatctctgaggacatttctagatctaaaattttatgactgtaatattcttcagtaaaataatatacaattctcttttctgctgaatatgtgacccttagtgttcatagaagttgctggcttttagaaataaacagtttgattcaggctaaatggagaaaaagtcacagatttagtgattcaaactacagaagtaaatgacatgattgaggttggagatgaggtatttactggaacatgctttgaggagacctttaattctctattgtaagtttgcacatggagtttataaaagcattttctaaatttctgcatcccttatatgaaggcattttaggcataaggaatggtacaaactagaaataggagaatacagtggtatgttgaagcacagataagtcctttagagccaaagcttctctgaggatttgagcctgtacccatgctgccttcagctcagaggccatgatgttccctctttcacatactcatctccccatgttccacctttgccgtccatcagatggcctgtgcacataattagaaagtcttgcttcacattattgttatacttggttgcctattaaaatgtaaaaataacatgtcatttgtctcttttcatgtatgcctccacatacttcatgctttttcttttttctttttttttttttttttgagatggattctcgctctgttgcccaggctggagtgcggtggtgcaatcacggctcactgcaacctccaccacctgggttcaagtgattctcctgcctcagcctcccaagtagctgggattacaagcgcctgccaccacgcctagctaatttttgtatttttagtagagacagggtttcaccatgttggccaggctggtctcgaactcctgacctcaggtgatccatctgcctcggcctcccaaagtgctgggattacaggcgtgagccaccgcgcccggcctatgctttttcatacttcacgttttgtgcttcatcttccctaaaccagactcccaacacttcttcttctcagatctttccactgtttaactggaaacccgcactttaacaacaggctaccttacctcctcacttcctcactggatgttccctttacctccttgctttactgagaaatggctctctgaacataggaacaggcaaagatttcatgacaaagatggcaaaaacaatcacaacaaaagcaaaaatgtacaaatgggatctaattaaactaaaagcttttccacagcaaaaaaaaaaaaaaaaaaattaccaacagagtaaacaaagaacctacagaatgggagaaaatatttgcaaactatggatttgacaaagttctagtatccagaattttaaggaacttaaatctacaagaaaaaacaaccccattaaaaagtaggcaaagaacatgaagagacacttttcaaaagaacatgcatacggccaataagcatatgaaaaaaagctcaatatcactgatcattagagaaatgcaaatctaaaccataatgagataccatgtcataccagtcagaatggctattattaaaaagtcaaaaaataacagatcctggcaagggtgcagagcaaaggaaatgcttatacatagctggtgggagtgtaaattagttcagccattgtggaagcagtatggagattcctcaaagaaataaaagcagaagtaccatttgacccagcaatcccattagtggatatatacccaaaagaatataaattattttaccacaaagatgcatgcacacattttttttgtttattggagcactactcacaatagcaaagacatggaatcaacctaaatgcccatcagtgatacactggataaagaaaatgtggtactgatacaccatggaatattatgcagccataaaaaagagtgagatcacatcctttgcaggaacatggatggagctggagagctggaggccattatccctagcaaactaatgcaagaacagaaaaccaagtactgtgtgttctcacttataagtgggagttaaaatgatgagaacacttgaacacaaagaggggcacaacagacactggggcctagtgtccatgtgttctcatcaccaccccagagggtggaggatcagaagaggaagaggagcagaacaagtaactattgtgtaccaggcttagcatctaggtgataaaataatctgtacaacaaacccccataacatgaatttacctatagaactaccttgtatatgtacccctgaacctaaaataaaagtttaaaaacaacaacaaaataataaaattaaaatcacaagggaaaaagtttcatgaattttggagacaaggaggattttttaaatgctttttattaaaatatactaaatagccactttagttataaaccgaacttcaaaatttgttgaattttaaggaactcagaatctcttaggtttgctattttttttgaaaagcagacaacacctaaacatagtgattctattttgcttgtgattctttttttttttggtccttgctataaatgttgtgtgattttttgattctatagatgcttttagagaaataaatactaaataaaaatggttggaaatactgttttaattatttatctctcattctaaaagaaaaaagattcatagtataaaatttcttcaagtccttggtatcattttggaaacagagttgtttctttgaaagatcagcagcagagatataaatttagaagtaatttgtgtaaaacatgattgtcaattccttaagaagacaagaaacttgaggggatgagaatatgggggaaaagaatggatgattatggctgaatcttcatcatttctactgtcacaaagaataattaagaggtaacagtaaaatataataaaaggagtggtaagagaaatgaaaggactgtctaaatgttacaaaataatatggaagtaaagtagtaggagcaaaagccatattgctatgaaagaagttaacacatccatcttcttcgttgttacctacaaagaagaattgaatttgaatggttcttggccagagataatttgtgtcaacttcggattacttattctagcattcaagaccattcatcatctgaaattcagcaaccaatactgatcttctaaagtccttgaagctaatatttgtcatctccccagtacaaactttgagacctctattctatcattggttctttactccactcttttccttatttgagttctaccaagggcccatcttaagtctcacctaattcatgttgttttccctcagtcctttagtgatcagtgtgccactgcttttgcttttaatctgaacctcctttaagttatttgcttacatccttttgtcttcccaatgagactattttcccagtgagcatttccagggcaagatccatgtttcttatttgctgcttaattcattgagcactctcaagcttcaatacattataaaaaatgggtaatttggaataagttatccctaaggtactcatcagagctaaagtgcactagatcttgaatgttccatatgtaataaatcctataaaaacattttactatatctcaggaaaaattaaaacatgcttggttaacctggttacagtgaattcttgatcagttataatcaaagaaagattcatgttctcaccaatatctgttcatatatttcctataataaaaggacctggtatgttgaatgcatacaaatactgttttgctattaatagttttatgataaaattataacacccttattttatcagtgcagtattttcagatgtaaatatgctattcatttcattgacttgataactctgttggtgctctgtggtagccagtatatatagcactgggccctgtggttcagtgcagaccttaccacctgctagcagtatgaactcaaccatggcttttaatcttactgagttcatttctttatctgttaagtggataatacattcttcactgggttgctgacagaattgagataatccctgtaaagtatgaagcatagtgcctgacacatagtgctagatatagtgattagtcactgtaatatggtatttgtcacatttaacaatgccacgggagcaaaatctctgcagtttttacatgttaattttatgggtgttatttctgttaacttttaaaaccatttgcacctagtattttatgtggtattttgatcataaaatagtaggttcttttcatagttatgtagaattgaattggctaacttctcagtgttccactacttataattttatagtgacaaagtgggttcaaattggaactaattatcccttacgtggctttcttttattatatgatgcaagatgcttgtatcacaaaatgaattcagaattcctctctctaaatctttaggagtcaaatcagagttaactaccaggtagagaaaagtcatgaaactaaaactgatatatagtttctaagggatacttctaaaataaacttttgtaaatgataaggtatcctgtacaccattttactacctatgcctattcccagatttcacttaagaaacattataaatttatagcctgaccacattgtgtcctaaacattgaaggcaaaccatattgtagggatttcattttaaccacagagaaattctaacaagcgcaaaaccgcagaaccaagtaagtagtagatccgggaatagaattgagaaggctctgattcctcctcacatactgagaccacagagttctgctccttctgaacataatgacagctcatccaatgcttctagaccaccagtatatgatacattgggagcaaaccatatgacagcactctccaaaggctcacagtctttactttctaaaggcctgcttagaaaccagagaagtagaagagccattacaagcacctcatgattattgactgatatttgtgtttggggtacttagttgctatgatgaagtttgcttctctgctaggttataaaaatgtaataatttgtaaccatagaaatgattttaccagtttttagtaacatttttgtaattattaatacagctagctaaagtgtttccttggaggataaacggcatcatacataaaaggagtagaaaaagtttacgttcccttcagaattgaccccccatcccattttacttttaaattgttgcttctttttgtctttagtgatttacagagcactgaaatggttgttttaaatattttgtcttgcaatatcgttgctgtttagggaatgaatttgccaccttcttcactctgtcatgctagaagtagacttatttttattactattttatatggataaaaattgcttgtatttccctacattttactattttattatacataggccttttaaactgggattatttttgttctttctgaaatataccttttagaagtttctttagtaaaagtcttttgatttttatttatctaaagatgtcttaattttatttattttttatttatttttttattattatactttaagttctggggtacatgtgctaaatgtgcaggtttgttacataggtatacatgcgccatggtggtttgctgcacccatcaacccatcatctacattaggtatttctcctaatgttatccctcccctagccccacacccccaaacaggccccggtgtgatgatgttcccctccctgtgtccatgtgttctcattgttcagctcccacttatgagtgagaacatgctgtgtttggttttctcttcttgtgttagtttgctgagaatgatggtttccagcttcatccatgtccttgcaaaggacatgaactcatccttttttatggctgcatagtatttcacggcatatatgtgcctcattttctttatccagtctatcactgatgggcatttggtttggtcccaagtctttgctattgtgaatagtcccacaataaacatacatgtgcgtgtgtctttatagtagaatggtttataatcctttgggtatatacccagtaatgggattgctgggtcaaatgggatttctgattctagatccttgaggaaccgtcacactgttttccaccatggttgaactaattaacactcccattaacagtgtaaaagcgttcctatttctccacatcctttgcagcttctgttgtttcctgactttttaatgatcaccattctaactggtgtgagacggtatctcactgtggttttgatttgcatttctgtaatgaccagtgatgatgagcttttttttcatatgtttattggccacataaaccttactgttgaagaatagctttgtctaggatgacagttattttctcttagccctttgagaacattatttacctgcctatggcttctattgttactattaaataattttttaaaatctgtagatttttaagtggctatagagtactcatgtgccagtcattgcattgagcacttaacatttatcacttcatttaatcctgctaacagccttatggtaataggctgttactattctcatttttctgataggaaatcagaggcacagaacagttaaggatgcacggtatgtaaggaggacaagattgatcccaggagctctgactccagagcctatgcttataaaccagtatgacagccaagtaaatacttaaaaagaaggataaaagatgattaacagtactaaatattaaaattactataaagctgtaggaattaaagcagggaggtatttttttcttgatagattagtaagactaatcattactgttagactatcattactgagcaataccaatgtggtatacctgtgtgcctgtttcctcatctattggatgagaataataatagtgcttacttcatagagtggttgtgaagagtaagtgtgtgtgtgtaatatcttataaaggaaaacatatttgttgtcatcagcagtagtagaataaaatgggaaagcacagaaacagaccctactatatatcagaatatagtatctaattataggtgatgaggagaaggatggactgttaaataaatggtgctgacatagttgggtgattatatagaaaacagaaattttggtatagcttgtttttttaatctatggcctaacagtaaaagtataccagatttagaggttaactattttctaaatctataatataattagaggaaattttcattaatagttaaataaatatatgtagaggagactgttgtaagcatttcatcaaaggagaaaccataaataaaagaattgaaagatctaaccacataaaaatttaaaatttatttggtgaaaacaattaggaacactgtctaaataattaatggcacagtgtactagattagaaaagccatttgcaatatatataacagaaggtactattcttaatgaaataataaagaaaacaactataacaatggaaaaatgaacaagtgaacatagaatctcccagaaaaaattacaaatgacaaatagacatagaaaaagatgctaggctacactagtaataaaacaaacaaacaaacaaaaaacgttaacaccagttttcacctgtgaattttacagtaatttaaaaagatagtctacccaagataaatatgtaattatatataaattaacataattgaagggaaataacaaacttacagagttttttattgtatcagaagaaaaagagagaaaaatcatctgctttgtgatatcagggggtagtggtttgagactgtccttgaattataatgttgacaagaagtgagaaattagtgcaaggtttaacattctctgttctgagaggtttgacatcagagggaagaaagataagtaactatagctttgattttgtcatggccaagggaggtggtcttaaaatcaggtagtcctgaaaatgcttggggacaggaaaggaccagtagtaaaggagaaattgcagctgttagtatagagaggtgcagttgattcagttaggtccatggggaggttcgaaacaaggaagcaagaatcattctcacaagttgaggaagaaaatagacataaaagtacaaaatattttaatgtaggggaaaactgagaaggttaataatgttctctctaccattgattttagtgaggtagtgactggtaagagacttgggagaccaggagaataaaaggtttgtaaaagctgctgctatggtctaatcattactattacatgttacgttgtatatgttgaaatgtagtcaccattgtgaaagtattaagagatggggccttttgggaagtgattaagccatgaggactcaaccttcatgaatgtttcatcagtgccctaataaaagagactgaagaaagcatgtttacccatgaagctagacgggaggaatggaagggccacaatgaagatctggccgtatctttcactacacccttacatttactaccacattatagccaaatagggcttttaaaccattttttaaacaatttttcttttttatctttcagctcagttattttgcttctatttttcctcagcttataaaaccccacatctctacttttgaaattataactattcattaaaactcgttcatttgttgctttgtctttgatcacagccagaagtgatatctatcttcggaacacctatcattccttgtttataccacttttatattacttcttatttacttcaaaaatttttgtttccactaaaagttaaattccttaaggaaagggaacatattttggtcattttatgttatttcacagtgccaacacaatgccttttctgtagtcagcatgtaaatatttgctgaacagatattatattacatatttatacttaagcagcaagatagaacctttaaaaggaaataatgttttcctatttctatgggctaattttaaaagtttatttttaaatagcattttattaacctcttctaatatgaatgtttttgtcccataggtatggcatgaattgccttattcagtttgaagattttgccaatgtgaatgcatttcgtctcctgaacaagtatcgaaaccagtattgcacattcaatgatgatattcaaggtaacaaaattttcactgcatatggatcaataacatgtctgaaattagttcataattgtaataatgattcaaattcaatcaatatatactgagtaccttttaaattccaggaattatgcttgctgatgtcacatactatttctcatctagttgcatatatttgagaaaagtactctctgactgtataatataccatattatcaattagctagaaaatgagctccaagaaatctgacaaaatccctggtgattatggctaaacaaagaatgaaatgtatgagaccatattattcaatgcttaaaagtaaaagtatacatacttctctcttcagcctatcttagccacaatttttatgctttaccccagtaggagctgcctttatgtagtatgctgcattttgctatttgtctttgattgtagatgcttggctacctgcttttgtctaagctgccaaattttttcctctttaagctctagttttttaatcctctccagatccatgcagagcccaccccccaatacacatgtcttactatgagaatcttacaggttctgtttcattattggaaggtagggggaagcacaggtagatgagctgaggagaaataccgtaaagaggttttgcaacttgaaatgagattgcaaatggcttccatttcactaattccaatgaatgtttttcagtgtttatcttatttgaattttcagcagcattccacattgttgactcaccttgtttcttgaaatactcttttctgttggcttccatgtcagggcattctgctggtttcttcttacctctttggctgtttgccttttctttttcttctgcaggttcatcctttcctgtctagctattaaatgacaaaacacttcatttttaaatgacctgctcagtgccagctccttttctttttgttctgctgtatgttcttaggtatatactcaggtccacacattcaattagcaaatttatattgccagcccagacttctttgtattccaggtctatacacccatgtctttatttaaaatctccacttaggcgcctataatcccagcactttgggaggccaaggcaggcagatcgcttgagcgtaggagtttgagaccatcctgggcaacatggcaaaactctgtctctacaagaaaatacaaaaattagcctggcatgatggtgtgtgcctgtagtcccagatactcgggaggctgaggtgggaaggattgaatcccttgagcccaggaggtcgaagttgcagtaagccatgatcatgccactgcactccagcctgtgtgacagagccaggccctgtctcaaacaacaacaacaacagcaacaacaacaacagcaacaacaacaacaacaacaacagaactcctgctggatatctcaaagttatctcctacttaacctactcccaaatcaaactcttatttccccaccaaacctgaccttcttccagtgttctccttttcagtgaattgctgatagctccctcttcagctttcccaccaaatacagtctatcactaaaccttttgcatttcctatcatcaaaatctgtgtttttcatagatttctcctcatcaccccagtgcaaattgctatcatctaagtaatctatccacatttactcttgcttccccttcttatatgttttctgcataatatctctacaatttgtcagatgtagatctaagtgctcaggcttttgtggtgaacagagatagttttctttttgctatagaaatctgatcttattagttcttcctcaaaataatttgatggattttcattgtacttaggataaagatgaaaatcctgaatgtggcccaaaatgcatggtctgatgcatgtttctctcgtcactcattctagccacacttcctttctcaggtcctgaaatgagccaggtttcttcttatttaagggtctagccaaatgttgatctctcatcctagaataccctttcttcccctcttcaaatctcatctcaattatgacattcatcattaaacccttctgaatttctgggtctgggtcaattccacctcataggctgccatagcactaattatttttcttttttccttatcatagtagcatttttatatatttatgcaattttttttttgagacagagtcttgctctattgcccgggctggagtgcagtggtgcaatcttggctcactgcaacctctgctcctgggttccagtgattctcttgcctcagcctgctgagtagctgggattacaggtgcgtgccactgcgcccggctaatttttgtatttttagtagagatgggtttttgccacgttggtcaggctggtctcgagctcctgaatgcaagtgatctgcccgcctcagcctcctaaagtggtgggattacaggcataagccaccatgcctgacctatttatgcaattaaaaaaatcagtgtctccattccaactaaattttaagctctgcgaaggcagagaacgtgggtattttgttcatcactgtatcattaacttgtcattaacatagccccaagcccacagaaagtatttaacgttagtggaacaaatcaatgtaatatgtctaaagcaggggttggcaaagtacagtctgtgagccaaatctagccactgcctgtttttgtaaagttattgcaacaaagccatgcccacttgtttatatattgtttacagtggctttcatgccataatagcagaattaagtctgggatagacactgaatggcacacaagccctaaaatatttactatattgccttctatgaaaagagtttgccaacctttggtctaaagaattaaacatgaaagagttggtgagtgttgaactaaggagttggtaggttgacttgggtaggtttgcatttggaaagattattcacactgtcttcagtctagagaacaggattgaattggagcacatttgaaggctgttgctgaaatctatgatggtggcatcttgctctaagaaagtgccagtgaagttagaagtagacaggtaattagttgttgatagtgaaggtgagaaaggagccaaggatggagcctaggcttttgccttgaagaactagaagaatggcagggcagtaactgagatggataaagtgagagacactgttaaatgcagatgttaagagcttggactatagagtcacactgatttgctttgccctttactagctatggactttgaccaatttacataacctctctgtgtttaatttcttacctgtggcagaaagttatataacagcttctattttttttctttgaaacaatagatcagaagtttgaggaaaacaaaaaatatatgtaatagccttaaagaaatatttatttctttgaaataaatgttattttcaaggaaaataacaatcctgttattttctttgaaataacaggattggaagtttgaggaaaataaaaaaaaacagatctgaaagaactattgtagagaactagagagccaacggactatgaaacataaaaggattcagtcagcagacattgcagattcagttgaaattaatactgtaaatgtatcatgatgctggctgagcagcttgagttcaacagttcaggaataggcaaggccacaatgaacagctggattcatctatgttagatattttattgtatttgtgcaaagaaaagacaatgggataaaagctaaggttaaaatgatgaccatgaccctaagctggatagggaagaaagtgaagataaaaagactgttagatgggggaaaggcctagacattccaatggggttgaagaatgggtataataaggatgattgaattagaggcctgggaagataggagactgtacaccatgagtaaagtattctaatgtagtactttcaaggattggttccgagtgatggcaagcacaagatgaaatttagaaggaagtcagtcgaagtggaataaaggtgaatgctattggaaatgaggtgatcaaagaaagtttaaatgtaaaatggggatgataatgtttctctcatggagtttacattgaggacaaaataattatttgtagaaataccctataaactgaaaggtactttataaataataatttttaggccaggcacagtggctcacacctgtaatcccagcactttgggaggccaaggcgggcggatcacgaagtcaggagttcgagaccagcctggccaatatggtgaagccccatctctactagaaatacaaaaattagcccagcatggtggcgcatacccttagtcccagctacttgggaggcccttgaacccgggtggtggaggtttcagcaagctgagatcatgccatgcattctagcctgggcaacagagtgagactccatctcaaaaaaaaagaaaaaagaaaaaaagtatatatataataatttttaaaattcaccatgcttaagtatttagtatggcagctatatacatttaacggctttaaaaatcctgagtctttatttcttttgagatacatgaaagtaattggtcaaatctttcttttccccaaattctttgtgatgttaattacattgttccttcagtgccaattttcatgacaaagatgcctaagttaagtaaactgtgttttattcttttttatattaaatttctttttgagtattcatgaaaagcaaatataggatttcagaaatggaataatctggaaatttccaggtgttaagaattgtgagctatagaaagatggcctgattttaatattatttgcattagtctattttcacactgctacagagaactttcctgagactgggtaatttatgtaaaggaaagaggtttaattgactcacactttcttatggctgaggaggcctcaggaaacttacaatcatcgtagaaggcaaagaggaagcaagcaccttcttcacaaggcagcaggagagagatgagtgaaggaagaacttccaaacacttataaaaccattaggtcttgtgagaactcactcactatcacaagaacatcatgggtaaaaccgcccccatgatccaattacctccctccctcaacacgtgggaactacaggtccctccctcaacatgtggagattacaacttgagatgagatttgggtggggacacagagctaaactgtatcagtattgcatactaacttgaagataccatgtataataatgataaagtgcctttggcgctacaaacacatgctttgtagaccagtgtttttaagtcacttgtcaattcattttgcagtgttctctaaaacagccaccagtaaactgttgaacaaaactacagaattcctttaatattgtatatcttctgattttgtgggtctgatgtaaatgtccatacaaagttaaagaccagtattaaataatttctaattatcatgcagagttaataggaaacagagttcagtttaagaaaacgaatgctaaattcaaattatcaaacaaaacaagcaattagggtcaggatttctatccatcaaggccaggaatttagaggtcaggctctggggtacatcagaattaaaggcgggggcacaggatatcagaagcaagagccaagcctaggtcaagagcagtgcaagaaggagccctgaggatccacagcataatatgccccccaagcaggtcaccacaatggaggcattaaataactagtttttcacgactaattcggcctaaaatataatctgcacatatatagtcttttatttccatataggaattttaaagtattactgccttaggaaataaaaagataggtttgagaaaaatatgtctaatctctgactagagaaaacctttggcaagttattggggttctgactagaaatgaccaaaccgttttgtgcacatcatgcaaaatcgtgcccttatgacacagtttctccgtatggttcttttttacctttttaaccttatgttcttaccattatgcccacagatgtaatactttcctctctgcaggcacagaaattgcattccagtgccaacaaaaataattatctaaccattacagccttaccatgtaaataaatgtgtttacactggacccttgggtggactcttttctttttttttttaaacacatttgttatttaaagatatgatttatgaaaagtatttgattaaaattgtatatacttagaattctactgttagttatctaaaataaccttaaataatatagattttgattcaaaatgtattttagacatgaatgcattctcattataaattattttaaactggaaaaaatgcataaattgaatctattaagaaattggccacataattatataatctgaagacaaacagaattcagcaaattcagactgaaaaaaataaggtttcaacctctagtcatttaaaataagctacaaaaagaaatttttcttctcatagtagcctctggaatagttactctgtaacatgacactctaaatattgcacatagaaatttttgccataataaactagtttgacttgttagtatttttaaaaaatacatttaatatattaggctacatttttgtaaatatagtgaaatcttatactgaatgctttgataattgaaaagatcaaaatcagacatggtagaacagatactcacaaaaggataccatggccagtaaacatatttttggagtttagccttactattaagtttttaaaaatttattaaacagcaagtgagaaactgattttctctatcaagctagcaaagatttttgttataaacccaactgttaatgatgcttttagaaaatgagcactcgcatccattgatggtagaagtatagattgatacaacttttggggagccagtttgtgtcaaaaacctaaaaacatgcagatctttacctgatacaattcttttgtacaaatttatcctgaagaaatagtgatgtgcaaattaaatatacaaagtattgcaatgctatttttaatagcaaataatcagaatcctctaaatatctaaaaatagaggtttggttaaatgaattaccatatacccatagtatggaatattataactgtacaaaataatattttaaaatatattatagacatggttaggtattcacaagatatttttaagagataaaaagcatgttaaaatagtaggtatggaatgaggtattttttgtaaattaaaattttttgaatatacacatatcagtatgagacaaaaatttgttaagactaaacatcagaatgttgaaagtggttacagctacacagtgggattacaggtgactttttttgtctttatctggattttaactgtttaatgcatttaccacaatgagcatgtatttatgaataactatttcaactgaaaaagatcaaacatggcacaattgttgagccataatatcaaaaatacctaatatataatctttcattagcaagataacttagtaccaaagctttttacttccattagtattctttccaaagtggtattgttgttgatgttgtaatttggaatttgccatcatctcatatcaatgacattcttcattatgtcaccacttatttgacaaaatactagacataactgatcgtagcagacaagttatacaaagaaagaaagaaaatagcattctgactatacttcttcctcttactcatagatttttctgagttaatactcatttaagacttacaattaatattctgaaacatttttatgtgtagatcctatatttatatgtagatcctgtaagatttctttatattaaaatgcaaaaaaaatttagactatcttattgtattaaaatgtgttttgtcaaatacttatgagaaaaagctcatgaattagaatgtaagaatattttgttgaatatttttattacaaaagaatgtaacatggaagaattttaaaatattactttgcctcggccaggcacggtggctcacgcctgtaatcccagcactttgggatgccaaggcaggtggatcacctaaggtcacgagttcaagaccagcctgaccaacatggagaaaccccgtctctactagaaatacaaaaaaattagccgggcatgatggtgcatgcctgtaatcctagctatttgggacgctgaggcaggagaatcgcttgaacctgggaggcagaggttgcagtgagccgagatcatgccattgcactccagcatgaacaacaagagcgaaaccctgtctcaaaaaaaaattattttgcctcactaataatgacaccccactactttgggaaagaagttcatggttaaaagatggcttgttttcctgtaacttcaacctctttctctctattgccttcttccctttagtctatgaccatagaccatatttaaattgatttcagtcttaaaattattgcctccattctattttcttccctccatcagtcaatgtctttcttcccttaaaaacataaaaataagatatttgcctcaaccttgtttccctcccaccccatctccatcctcaccccattcttccttttcttatctaagcttctccaaggagtgttccacacctgctctccctgttcttcaccttttatttcttcctcggaatactgccatccatcttcagccctgacatgcatgccactaaaaacggctctttgataggtcacaggtgatgtaattgcaagatccaatagcaatttttcattttctttcttgattgacctttgttctttgtcattacttctctctgttttcaggtaagtatatgctcttttacctctttgataattttttctctgtcaatgtgtgttataacaaaaatgtgttataacacatttttctgccctctgttccttaaatgttcatgttcatttaggttctctcctttagccactcactctgaataatgttatcattccacacgacctcaatacatgttttaaaattctaaatatctgtggcccagattgtatgtaactatttcttgatactgctatcagaataacacatgacaggaagcacaagctttgtgcaaaagctcaaaattgaacctcctaatttgtttgcatacccccagcctcaaatttctcaaaaccatcacccaccactattctctgaatttaaaatctttaaacaccatctgctacctataatatattataattatatatacccatatatacctataggtactattagtatatagtagaaggccctacatgatctgaccccaaaacttctctagcctcatatcactttgcattctagtaaggtgtgtttgcttcagcaacactgcacacagtttcacatgtgttttatgttctctctccttttatattttagaaggctgggcatgcagatggaggtagtattctgagtctttactgtaaggtgacttggttgggccatttccttaggtaatcttccttttcagtctctttggattccttctcttacactgctgagattccacagaaaagatttttccaatctcgctcctgatactacctttctgccagtgctctttaagtaggagaagattggagggtctccgtattgagtatgtaaacttccagttaagcttgtttctagtatggaatccttgcccccaattatgcctggtgtcttatactccaatgaccctttccagaaaatgagcctcaagttttctttcaaacttccagagtgtggggaagttgactatcttctagaaggagagggggatgcagatctgggttttaactgatatatatatatatatatacacacacacatatagagagagagttatatataattatatatataatttatattatatattatattatataaatataatatataatatataaatataagataattatatataaatataatataattatataatatataatataatataattatatattatataaatacacaattatttaatagatcaatataatataattataatagattatatcgatataatgtaattataatagattatatcgatataatgtaattataatagattatatcgatataatgtaattataatagattatatcgatataatgtaattataatagattatatcgatataatataattataatagattatatcgatataatataattataatagattatatcaatataacataattataatagattatataaatatataaatataatctaattatataatatattatataaatatataaatataatctaattatataatatattatataaatatataaatataatctattatataatatattatataaatatataaatataatataattatattttatataattacatataattgtatattatatataattaaatatatatatttaattttgagacagtatctctctctgttgcccaggctggactggagtgcagcagagcagtcatagctcactgcagcctcaaactcctgggttcaagtgatcctactgcctcagcctcccaagtagctaggaatacaggcatgtaccatcacacccagctaatttaaaaaaaaaatttttggggggtagagatgggtatctctatgttgcccaggctggtctcaaatccctgggttcaagcaaccctcctgccttggcctcccaaagtcctgaggttacaggacataaacctctgcaccctagccttcttaacagacttttgaccagcttcctgttttcaccctctcctttatccctacttccagaggcacttggtgcctcctatacctgggtttttgagagttttgctgtatcagtctggtcacttattccccactgccggccaacaattcagctttctcaagtctgctaagtcagttgccatttgctcatttagaagcctgtcagcttctaaaatgttgttgctacccttttttgctacccttttctcttagtctttttaatttttttcttttcgaaaaagcagttttctattgttttagtagagtttgttggggaaaggaatactaattgtgtgttcaacttccatttctaacagggagtcatccctgccttcatgtctttgcatatgcttttcctactcattgtgtcctcttgtctgaggttctgaaactcttacattaatcaatactgtgttcagggagtatgcactctaaatgccttgacctttgcctagataaattcacccatccccctgctacttctagttcttgtattttacccaatctatttagtagcacatgaggattataattatttgattacatattgatctaccttactaaaatatatatggtaattttaaccagatttaacaaattattgcattagtagaggctattctttgataaaaggtgagacttttatttaacaaccatatgttgttatgtttatgtttatgttaaagtcgtaagtttctaaaatgttaagaaaaattcgatctgtttagtatcttgctaacagtgttaagtcctctttaaaactgatagtacaggcggggctcagtggctcatcacgcctgtaatcccagcactttgggaggctgaggcgggcagatcacctgaggtcaggggtgtgagaccagtctggccaacatggcaaaacgctgtctctactaaaaatacaaaaattagccaggcatggtggtgggtgcctgtaatcctagttacttgggaggttgaggcagaagaatcgcttgaacctgggagatggacgctgcagtgagccaggatcgcgccactgcactccagcatgggtgacagagtaagacgctgactcaaaataaaaaaataaaaataaatacaaaaactgatagtatgaagataaacctaagcacgaattctgtctgacttataaaaagcttagttttaaatcttaaagtaaaacttattatggaataatttattgtaaaaatttacagttttatgaaatttcaattttctacatgtattcccttctctgcaatgaaatttaaatcaaggtagtaccaggccatgtacaagaatcatgttcaagttaaatttttgatagtgctaaaaatatctttctgattttattaattaattctataaatggaagattagtgttttcattgtgttctcaggaaatattatgaaatatatctttaaatataatgtatgaacttaacacattttgagttttaagtgatctagcataaccatatgaaattaaggtaccaaataggatattttagaatattttctgtctatctgaccgtaagtgtccaattcgatgtaaataaaaataataatacaaatacagtgattgctgatgatacttcaactttgatgcttcaattggttaaatcttatagaaacccttaaaatcatagaatctcagagttggaagggagcttagagttccccagatccaaacttctgggcagtttacttcaaaagaacccaagagagagatagcttgagctactatttctgaataacttcttatttagtaagtggatatctatacctctctttctagtttaaattctctttcatctgtttaatgactctagtgaatatatcttgcatggggaaaatatcattctaatcatgtcatgatatattctctacatacactagccatattttttgcatagattttcaccttaagtaatgtatagaagagtggctttttcataatatatgacttagcacagttcataattattgcaatagtgactctaaattgcatgcattttatttttgtagtacacattgtgatcctaaagaaaaggcacatatgggactaacaggccttcaacaattattgtttattgtgttcttatttgcggctacctaattatacaagaaagaaactaaaagattgaatagaacaaatttactgattgtgaaatgttgattacctttgatacttgacatacataacgcttcatcgttgtgtcattcatcaaacctagtctaatctttgttttaaccataatgttaaataagggtatttaacgtttagctaggctttactacccagctgagtgatgtaggaaacattataggtagaatgttaccttggaggagtaaagtatagatacagctggaaagtgttgcaagaagctgctgctttattagccataaagaagttgagctgtgtaattacacttaaagcaagagaactgctttgtgatctgtgaatgcttatatggtaaagtaatataattggaactggtgaagtttttatgcctatgagacatgatgaggaaaatataatttttatcttaagaaattttgcattagttttgtctagtacctttgggatccaccagtgattttcataggtaaaaagtctattaaatgatacaatataattagattttacttgccattaacattaaattccaaatgtatcaaaaatattatgagcaccaataccatcatcagcaagaatttactatttgtgtcctcctatctcaggttctgaaactcttacattaagagtttctttgtgtgaagaagagtttctttgtgtgaagcctactttgtgtgaagaagagtttctttgtgtgaagccttctttgtgtgaaggggatcattaatagatttcaaaaccccaagagtaattagacggaagaatctaatagcacttattactcttttatatcataaagtaaaactactttacagatgaggaaactatctatttgatgtacacaataatttctctaaattctttcagctagtcagtgggttgttgagctagaatctgaggaatccagatcccatcctttcattgattatgtcactaagataagtcacagaatcttcttttagggaagttttcaagaatagtagtaagctgctatcttaaaatattgatgtcagtagcctgggaattttaccacgtatgcaagcatgggataagacaaccacaggtttctcttctgtaccagttaacctgttttatgattatttcaagttgtgaataaaagcttgaaaattggcaggatctgtttgaggattactcaaggatatttattacttgtttcaggaacagcatctgttgcagttgcaggtctccttgcagctcttcgaataaccaagaacaaactgtctgatcaaacaatactattccaaggagctggagaggtatttgccttgtgtaatacttatgttctcctaaactaacatataattagtgttaattgctcattaactcaagatttgacgtattctttcaaatttttagtatattatgactgtaggctttatggaagattcccaaattaagtactgagacatattaattattcataggataatttagtacagaagtaatgagatatttttcacagttttaaatttgtggtattatcaaatgttgccgtaggtatttgttatgcatatctaaggtgccatacaggaaaactttccaatgtatgtgtatatatgcaagcttttatgtatttaagctggtttatctgatactggcttttagtatactccagtgttacaaaaacaagtttttaaaatttgactcacaattcagtgtgtatgtatgtaactacatatgtgtttttaagaaaaaacattttgaattagggatttgtagtatattattactgttcacatgcaaaaatcccaaaatattttaaattgttggaaagagactgcagcaaaaccaaattatgctttgttattacttgcttaatttaataatctgaaagaagaaaactagactcctgtaataataattcatccccaaactagaaattaaaatgttagttgagtttgagtttcttatgggaaaactgccaaaatctctttagaattatagaatgtaagtaatagagaaatattttgtggctatatatatatatatatatatttttcaagaaactttaaattttcaaattgaatatgattatgaacacaacaatatgttacactggtagatcattgtttatgtcatattggttttcattttgcttgtttttagataaaacaaaatatgtgaagttagaattcaaatgccacgatacaaatatgtgaaagtattcagaatgtaaatcacaaattcactttcacattgaaataaaaatcaaggctaaatgacagctcattaacatttgagttctctattttgcggattattacatgctgtatttaactttagtaaacctctttgaattttcaaagggtttgatgaatggcacaggccagttcttgatactcaactaggcagaagaattcatggttggatgattcaaaactagcacttgtttgtccctggaaagatattggaaatttcacagataattataaaatttaccaaataccaaggaagttgattcctttaatcttgcaataaatttcacagcacttttggtatccaaattagaagagtaagtagatgcttggaaacacagatcttttatttttcatcagtttcattctgttgcctaattggtcaagttcccatccaaatgaccaagcttctttcttcaaattcaattagagtagcttgaacctaacaataaacaatacagttcaatgagcaaggttgaccagttcattattttgaattcagtattttttcttggagcaaatcttggttgtattaacaggattaaatacactgacaatcaaggatatcaccagtttatctgtggccaaatagcaagccacataatagtggctctgttgtagtaaaaagggtaaataattgttatttggcttaacctaaatgtgacaaaaatattttgttcccactaacaaagacaaaatggggtgaaatgtaacccttaataagatatcatgtagaacaactttaaaattttttcttttcatcactgaggctgccctagggattgcacacctgattgtgatggccttggaaaaagaaggtttaccaaaagagaaagccatcaaaaagatatggctggttgattcaaaaggattaatagttaaggtaagaatttgtcatttttaaccagaataaagataactatgccattctggatggccatctcaaagacaactctgtttctaccacctccctttacactatattaaaagagtagccattaaatacaaatgatcatgtcatacagaatactgatactcttctgaataaagaaaactatgacttaggaacagattccatctgcaatgtgagtcggctccttacacccctttgaattgacagtccatttgaattagtttagttttctttctttctttccttcctttctttcctttctctttctttctttctttttctttctttccttccttccttcctttccttccttttctttctttctttctttctttttctttctttccttccttccttcctttccttccttttctttctttctttttctttctttccttccttccttcctttctttctttctttctttctttctttctttctttctttctttctttcttttctctctctgtctctctctctctctctgtttttgaggtagggtctcactttgtcactcaggctggagtgcagtgatgcctccatggtcactgtagccttgacctcctgttttcaagtgatccctatcccaccttagctttctgagcagttgggaccacaggccgccatatccggctaattaaaaaaaaaaaaaactgtacagctttcactgtgtttcccaagctggtctcaaactcctgagctcaagtgatcctcctgcctcagcctcccaaagtgctgggatttacaggcatgaaccactgcacttggccagtttagttttaaatttagcaatttgatattgatacagatgaaacacctagatatatcactttttattgagagttggtgatcaaattgtacattagctagaaagaaatgaggaaagaaatgaaatagctaccctttacctgctacttcctctcaaccaaattcttaagggtttgaatgggaattcctgagagaaaactttgataaatagcttgtttgaatgttatcttacctgagcttgagtttctccatctttaatagtgataatagtatctacttcatagtattattttgagaactaaataaaattaggtttgtggccatattgctatatagttataaggcattattaatacttgtgccacctgtgcatatcaatcattctttaaactgctagaaaaaagtacatataaatccccttcctatgtgaagatgaatgattaggaataaataatggtaagcagtgtcttccggaatttagtatagaagtaaatgtgaatgtgtacatacagactttctggaaagctgttttatgtgtattcaaagcctttaaaagtttatatttttgagccactagtttccattcaaagaatctatctcatggagatagagatgtatacagtattttatgtatgaggatattattgcagcattatttacaataatgatatggtttatcacacattaattataatagtgatatgttacacttacctaaataaaggatgattgtcaaatgaattgtggaatagccacattagtatattgtataggctttaaattgttttcaaagagcaataaatgacatggtaaaggattcataatataatgttaggtgaaaaaaacaaataccatagtatatattattttttatttaaaatacagttgtatatgaaagtcatagaaggaaatatatcaaatgcatattaccttaaaacatttatttctaatgtcttttttatatattttgaatttttagtaatctgttcctttaaagctagaaaaatatttgttttttaaaattaatatacataaatatgtttctttaaatgaagaaaaaatatatgcataacttttgtagtaaataagtatatataaagacagaggctttcagtatggatttcttggcttaaaaattgctattgctggctgtgcgtggtggctcacgcctataatcccagcactttgggaggccgaggcgggtggatcacgaggtcaggagatcgagaccatcctggctaacagggtgaaaccccgtctctactaaaaatacaaaaaaaattagctgggcatggtggtgggcgcctgtagtcccagccacttgggaggctgaggcaggagaatggtgtaaacccaggaggtggagcttgcagtgagccgagatcgcgccactgcactccatcctgggtgacagagcgagactccatctcaaaaaaaaaaaaaaaaaatagctattgctttgaagaatcagcatagtatgaaaattttgtacactgtcatcatgtgacaagttgtgggcatgaaataagaatgtttattgaataaaaccacctatggatcgggtgttgttctagactctggggattcaataaagcccttgatcttaggaagctgatagcctagtgagaaaaattcaagccactagttacagaactagaaccatatgaaagtattataaaaaatatgttcatggtgtcaaggtgcacaggagatgatgctcccaactgcactaaggaaaaagatgggagtactgaggaagatatcaagacaacgtgtctattaagctaagttggaaagcaagagttaggagtttatctagggtctccatggatatcttaaatttcctatatacaaaactgaaacaaaggaaatatgatggcaagttcactgagagatcttgatagaagctaaagatgatgcctttcatctctttagatcttcaaagttctatacagtgtgtagtacatgcctgacaacaaatattttgttaataaatgagtgaataagtcactttacagacaggagaaccagcatgtacaaaataaaatattttggtataagggacatttacagattatattagaaaggaagcagatgataagagatgaagggctttccgaaccctgaagatgagcaattaaacaaacctgtgcaggggggtttgcctctcctttactctgatggcattgtggaggatggattgcaatgaggggaaactgagaaaaagaactagttacaaagctgttgcaataatccagatagaaattaattggggcataaccagaggtgagtgaaagaaacttaattcagtaggtatttaggaaatagaagtggcatacttagtaactgatgaaatatggaaggaggaatagggtggagtggaggaaggagtctagatggactccttggggtctgtctagtaaggaataaagaacagaccaatttaagggaagtaacaggatcagtttcacacatagaaagtttaaggtgattgtggagacctcagacagagatgtcccattggcagttggagatacgggactgatacagaggataagtgtctgggttggagatagggatctgggggtcatcaccatgtaaatagtaggaatagtaggagctgtggagaaagctatacaaattgttgtccttagggatataaaatattcaaaagtccaaaaagtggaagtctatgtggttttattttgttgtctctgatgacatttttacctgaaatctgtgtaaaaatacatagattttagcatcttgaataattttaacacacatttactgagctgagattccagagtccatggatataatacttggaataactgtgaagtagttggctagatctagtcagtctctcttacttcgtgtcttttacttgccaaaataaagaagttcatatattctgcttgccaagataaaattacattttaaaaggttgttatatatttaatagcttgtacactatttaatataaaagatacatattaagtttcactttttctttcatgcttttaaacagtcaaaatccttatattgacttttgttgcagaactaagccttagaataaccagtaaattagtgtaatcccattttcaaatttacatgattcttttgtgttttttatccttcattcttagtacttttatatctcctgagaaccaataataataattttattaattttattaacttataatataattgtttataaaatgtaaaaataccataaagttttaaataaaaaattttcttggtgaaactccactttttaaaaacaccatgtcaaaaactcaaacatgaactgtgaagtcagctcatctttgaagttatatcatcatcacgctagataattattattccagcatattttctctttcaactttcaacatcacaggcatagcattttccatcatttacaccatatccatatgtgcagtggaaagagttaatgctatagaataccaatattgtaaataattcatccatatcaccaaggttaattgaagtcaattacttggttatggatcatactcaaatatctttgtactttatagtaataaacataagatgctttagttttttatagtggaaaataatttatatattaattttgtcaactaatattaatacattttaatgtaaaactaatacttagttttaaaaaaccttccaaaacaaaaattaaagtaagaataaagacagtgaaaagagaatgaaaagggaatgttgcctagtatttgcattttgcagtgaagatttggagcattttcaggaggataagaagccacaaaacaaaccaggtttaatctttgtcttaaataaatattatattttcgctctcactaataaacgaaattaatgctgacagaacttcaaaataaaaagtaggatattaacagaccttacgaaggatcgatttcatctaacccagaatgaagccatagactggtttgaatttcgtttttatttttattttattttgttttgttttaaataattttgctgtactgtatttttctgacttatagttaaatgtttagctcctgtagaaagagatggtcaataaaggtatattgtatgttataaaggtagttttgacaatatagttatttcattcctgaaagtataatctctaggtcgagggcttgaaactacagactatatagtttatctgctattttatcagaatttttgactggtgctgccttcaccctgaatgatggttaatacatttcatacaatgtggtttaataaaaaattctaactccaaatagactatgtaagctggtaaaaagtatctggcttgattgttttctccctcttttttatttcaaatagagtatgatcaatgcatgtaggtattaaaaagaacagaggccaaagattatatgcatgagtcttagaaaattatgaatattgatttttaacatacaaaattaaatactgatggagttcaccacctactatcttacattaaaaacactccatgccccttactatacttttgtcacataatttatcttagtttaatctgtcctgagatgatgaaacacagctctggactcttttagcaagtgcacatacctgatttgcaacaaatgcagtgaaatgctactgactatgtgctgagaaagccctgtccacagatccaaagaggggccaggttcaactctgataaactaatgacatgacagcaaaaacaggccagtaaattgggggtaggtagtccaactggggcttgtggaagagtttttctagtccctgtatgtaggaaggaataaatatttatcactggtaatctagaattaatttacttattcctatcctgggctgtggaataatagcccaaaatcttggcagcctttgcccccattctcctccctatgcccactataaacatgtgcttttgaaaaggtagtaattaaatctggttatatcttctacgatatagtaagaatcatcacaatataaagggataggggagattaaagtaataatatcacaaataaagtttcagctatccataatatgtttgaggtaattagagactcttgaaaaaaacagagagagaaaagatgcatcatagaatttgggatttctgaggtgagaggtgcccacatgcactttgccaaaagaaggcaaaaggatttcagcaagggatcctgaaaagggagaatgaagggaaaagacatctactcatctccataccaactgaagttattggcataacgaatatgtattccaaatcagattttgaaaaataaagaaaaataagccattagtctagaaaatagaagtccaaaggtacaggtagttgcctcagtattaccggatttagaaaaggttgtcacattccagtagtttctttaaactaggtcatcaagtcaattttgaaaatggtagagaacatacttgggagacattttgtgtgtgtgtcttttgcttcttctgttttgtcaagtaagaccttcagtattgctagtattaccatttcgtgattcctggacttttttcagcattctttcagcacttgtaagtcataccaggaatcaagcctttgaaagtgttgccatgggtaatttatgcttcttactagatggaatgtcttctggctaagttctggcttcagtgtctaggagctgccagtgggtatactatgattaataaagatgtttatgattaagtatatatctttttcttttcatacattattcatctgtcttttttattatttgtttcccattctaggcaatttaaatatttttcattatatctcagcttgacagccaaaaaagctgtgacttccaatttatcttattctatagcttttcttctttagactcattattgtatacttttttgaaaacatagcacataacctcttaaaaacgcatgtggtagggatatgatagatcatttagtacactgattctcaaaactggctaatcatttcttttttttattttttatttttttgagacagagtctcgctgtcgcccaggctggagtgcagtggtgtgatcttggcttactgcaagctctgcctcctgggtttatgccattctcctgcctcagcctcctgagtagctgggactacaggctcctgccaccacgcccagctaattttttgtatatttttagtagagacggggtttcaccgtgttaaccaggatggtctcgatctcctgacctcgtgatccgcccgcctcagcctcccaaagtgctgggattacaggcatgagccactgcgcctggcctacagcagattattaataggagaaaatataccaaaactttaagtgctggaattatgatttttttcttcttcacaaaaattttaattgcaacaacaactagcatagagctcttactataaaccaggtacagtcctgagtgttttacatgcattacatttcatttaccccacaaacaacctgatgaggtagaagtccttattatccttatttacagatgaggagacaagcacaaagaggttcatatgtttcaaattttttaataattcagtatattgcttttaaaaacagagcctgtctctactaaaaatataaaattagccgggcacatgcctgtaatcccagctacttggaaggctgaggcaggagaatagctttaacccgggaggcggaggttgcggtgagccgagatcgcgccactgcactccagcctgggcaacatgagcaaaaactctgtctcaaaaaaaaaagacaaacaaaacaaaattaaaaacaacaacaacaacaacaacaacaaaaaaaaacagagcctggcatggtggctcacgcctataatcctagtgactcaggaggctgaagcgaaaagatcactcctgaggccagaagttcgagacaaccctgggcaatatagcgagacccccatctctaaaaaaaaatgataaattagccaagcatggtggtgcatgcctgtagttccagctactagagaggcttaggtgggaggatcccttgaccccaggagttcaaggctgcagtgacctctgatccacagcactccaacttgcatgacaaaatgagacctcatttcaaacaaacaaaagcaacagaaataaaatgataataccctttaaagaaagaaaattgtactatcttcattattaacaatttgcaaagactatgacatactatttgttaagtttttgcccggggtgattctgtgctatattgaaaaggctttgagttctagtacaatctcttgccttgagcaagtcccttaaaacctctgaacatgtttccgcatatgtaaaatgactatacttatacttgtcctgcttctcagaattgttgaggggatcaaatgaaatatgtgaaaacaacttgtaagtcatcaagtaccatataaaattaggcagtgatccattatgtagtcaaatctttaaaatttgcagctagaatattataattagatgtttactagataacacatggcgcattcataatcagaacattaaaaacaaaaacatataaaatgcatacttactgagaaaatctaacaatgacataaatatgacttcaaattcttttcttagtcagtagcataaattggtagggctaaagctgaagccaactccaaattctgagacctgctataaaacacaatgtgtgacgaacaatataattatttaaattatattttgcatggccatttgttaatgctagttctcacatgtctgtaaaattaggatttttaatatcaattaaatgaaggactttgttttgttcactgttacatctccattgcctagaacattgacatataaatatttgttaaacgaatgaatgaaataacattctgacaattgaagaagagattttaagaatagctgtaacacatcatacataaaaatgttaagcataaatatttgtaatatatgtaccgaaatttattgaccctcacatgtttggcagattcttaattttttcttactggctttacttagggacgtgcttccttaacacaagagaaagagaagtttgcccatgaacatgaagaaatgaagaacctagaagccattgttcaagaaataaaaccaactgccctcataggtaagcattttctcctctcccttctcccctaccccttattttgacctgattgttttttttactaccaatttttgaggtataatttagcctttttgaattcaaaaaactacacgttcgctcaagcgacagtaccctgtagagacctagatttttaactttagtcctgtcgtctttctcttactgatctgagatgaagcgtatggccccctcctctaactcagcctgttaatacctggcacgttcagcacttttctaggcttgattactccagatagacagtggttctcaaataagagggatttttgccctgcaggaaacatttggcaatgtctggaagctttgagttgtcttaactagggtagcggggttggaagggagtaaagggaggggctactgacatctagcagatagaggcagcggaatgattctactaaatatcctgtagtgcactggacagcccctgcgacaaggaattatccagcctaaaatgtcaatagtgctgaggttgagaaatactgcagtagataagaccctcctggaagacagggatcacatctcacaaatctttattttccttatagcacttaatacagtacttacacaatgcatgtgcagtgcaagactttaaagtggttttagaaaactcaaaggaatttatgaaactttattctttattttgtgcatatataattttgatttttaccttgtattatactccattcctacaagctcttgtgaaacagatgacaacgttgaaaataatgatgataactacaataaaagaagtacttactccatgacaggaactttactaagtgtttaatattgtttttacaaaatatattctgtcaataatcttattgtttttcatttccattatgctaattgctttattcttctgttaaagttacttcagtgggtggtactttacttttgcagatgaatcagatggttgtcttaagtgatagcgttggtttataaaacttaattgctttgtagcctgacaagactgaaatatactcatagaattgcttataaagaaagtttacacattagatacaaatttccaagtgattggtaactaactcaatgtactatggaagccaaatattatctttagtttttaatagatatttgtagatttgtgaccctaaggattgtaaggattgttggcattaacaaacttgcctctttttgtcactatacttgaatacaaatagtttatatagcattttgtttagggtctattagaaaatgagctgatagatatcattgatttgaggcatggtcttcttgtgtgaattaaccaatgatagtgttaattaccagcttcatatttcttcattaggagttgctgcaattggtggtgcattctcagaacaaattctcaaagatatggctgccttcaatgaacggcctattatttttgctttgagtaatccaactagcaaagcagaatgttctgcagagcagtgctacaaaataaccaaggtaaagtaaaactataacagatattttaataatcaaatttttattcattatagggaggcctaggatatctaaggtgcttactgtttaagtttaaaaattatacaaccaaaatggaaagaaaagcacacaaatcagagggataagaactatttccttttctagaatgttgtataaatcctcttcttcaacaaaataaaatacatattttaatgttttactgataattttccacaagtgatttggaaatagatatctaagatttaaacataaaagttaaatagaaaggaagcagcttggttctagaggcttattaaaatagcttttaactagctattcccaaacactgaagcatacaatgtaaaaccacaaccttatttttgctttgctaaatcctgggtttgggttttggtactatgggtggaacatttgggcaactatcttgacatccagccagactgggataggagtcctcaatgcttcaacattttactatgatttattttataccatgtttgtactaatatgtatttggctgatatgctgaaaggagccttttttcccttcaaagactttaaaatatcattacaacaaaatagaggttgagtcatatctatctaaaatgtttattttggaaagaaatccaaaatgaactagagaggtaaacatgaacgctatgtcactctgcattaactggaacttaatggctctattttaatcatatatccttaaatgctcaatactagaattagtgatttttctttttggcaaggagccactccattgtttatctctcttatttgggatggcatcagtgttctcactgattttaatttttatctcatctctagattggggaatttgcctcacattattcagtagtccttaaatccttaaaggaaaaaaaagtcctttcagcaacaaccaagtcttagcatcatgccttgcacctactaggcatataataaacaagtgtttaattaattattttgtcttaatatatctcaacaggcctcaagggttaagagacttatctataacacacataaacaaaattagccaaatttatgtagttgtattttaaactttgaatgtgtctgatataaatgtatgcctcaactctttcttatcatcttgcctaatgttctatgtttttctacataaaacattgaaagttattttgaggatgaaaatttagacactggtttggctaaaggattggagaaaaaggaaaggtctgcctgttgctggatgtgagtttctgctactgtaggcacaggtgaagataggaaaggttaagttacaatatacagaaagactattgaaccataaaaatataatctaaaaatggtatgggaaggttcccttcaccatgttaataacatatatatatgagaatatttagctagctacagtactgtcatttatttaatgacatttctccttaaaatatggtgattatagaaaggcaggaagagtgggagtgcaggagtgggggagatatatatatatatatatatatatatataatgttacaggcctctttctcaaatataattttccaaaacctttatatatgaagtaataatttagttacattagaaagttgtttataacaaaatgttttatctgctaaagagcttaaggtatcagacttgtctgaaaacaaaaccgaattctgtgcaaaacataacagtgtcttataaacagctagatgagaatttgtttttctgcctcatctattttcatctttttgtctctcaaagaaggttgaatttctgttatacaactttaagaacaactaaaaggtatattatgacatttgctaaaaataggttaatattaatatcattatttagactctagatccaagagatatgaaagttaaaacccattctgtcatcgtttaaactatgccttggggatttgatgctttagacttttcaaatagatttcttagactgtgatgctttatttgtttagggtttctgattcctactttgaagcctaaatactctcaactagatgtccactctcaccatcacagacaaatgttcttttgattagcaatatgaaatgcagcacctaacaggccctagttaatgcctttttttttttttttttttttttttgagatggagtctcgctctgtcacccaggctggagtgcaatgaatggcacgatctcggctcactgcaacctccgcctcccagtttcaagcagttctcctgcctcagcttcctgagtagctgggattacaggtgcccaccaccacacccagctaatttttgtatttttagtagagatgggctttcaccatgttggccaggctggtctccaactcctgacctcaagtcatccaccctcctcgacctcccaaagtgctgggattacaggcgtgagccaccgcgcccagccaagttcatgcctttttaaagcaagcagtacatgagattcctcaaaacaattatgacaaaatattaatactaggcaaaatgaagacaattgttgaaaaatattgataacttaatcttcttcttccttgccaattctactcctgccaatgagtttgtttcctatgtgattctccacataactattttattttattttatttatttattattattattatttttattttttttttttttgagctggaatcttgctttgtcgcccaggctggagtgcagtggtgtgatctaggctcactgcaacctctgcctcctgagttcaagcgattctcctgcctcagcctctcaagtagctgggcttacaggcacccaccaccactccccagccactttttatatttttagtagaaatggggtttcaccatgttggccaggctggtctcaaactcctgacttcaagtgatctgccccactcggcctcccaaagtgctgggattgcaggcatgagccactgtgcctagcccacataactctttacaatatagaaatatatatgattttcccagtttttattttggaaatgtgtcgattcctaaaccccaacctaaaatatcattattttcaatacttaaatattagcccatcattttttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggtattgtaaaatcctctaagtttaccaagggtttaaaataccaagtgtgctcagcctaggttgtctaatgttttatttatctagcatctcagcttactctctgaaagaagtaaagtctgaagaacttcccagtggagtataaggggtgggtagcatgttcatactgactcacaaacgaaaggttcttcttcagtagtcattagaaaaattgtgtttttgatttcttaagaggaacatttttgtgtcttcacacatcagatcaagttctgtgacagtgatgggacaattaaaaatattgtttccagggctgggtgtggtggctcatgcccctaatcccagcactttgggaggctgaggcaggcagatcacttgagcccaggagttcgaggccagcttggccaacatggtgaaacttcatctctactaaaaatacaaacattagccgggcatggtggtgtgtgcctgtgatcccccctgactcaagaggctgaggcaggagaattgcttgaatccaggaggcagaggttgcagtgagctgcgattgcactactgcactgcatcctgggctacagagctagattgttacctaaaaaaaagcaaaaacaaaattgtttccaaatgatgattaagtggtaaatatttccctgttgagaacagtgcttaataatgaatggcattttgaaggtttaaagtgaaagtctgatatggtatagtggacatgtttattattcagggttcagtacaggagacagaaaccaccctagtatttaagcagaaattagatcaaaataggaaattagttgtttataaaatcattaaaagaataggagaagtgagctctgtctgggccttgaggaaagattctcagaacatcacaaagcaggcccactggggaatcttgtactgtcatgaaactgtgaaagatctgagattttactctacttgcaagctaacaagttagccacaatttcatagatattgacagaagacatgaaactcttaggtcagagacaaaggactttgataattcctggcacaagagatatcatgagctgcatgttcctatcagtttccctcctcctcccaagcctcagcaggatgatacggtgattgggcatatatttataaaatcatgagctttttgataatcatcaggttgatgttcatcaggttgatatcatgtttcagatttgaacaggtaaccatttatggatgagaaacttgagtgaatttcttttcttacgattaaacctttgcagctgaactgatccaaagaacttgattgatattcaaatatttttatcctgcaaatattttttccattgtgaagaggaaccccaagaatgtagacaaagattcttatgttactgatgtgatctaaaggagcataatcttggtggctagcacccggtgtcattctatgagaacagatgcttggaagcaataatgttctcctgtcgttttcttcactgcattaaaaagcatgccagctgatgtcacaggttttctttaactcagaaaatcttgttaaacataaatggatgtctaattactaagagagcatgtaaaagtagcttttgcattaaggaaaatgtaatcattgtcttttagaataggcacatcagagttttggttacctgcagtagtcagtgttttctttcttaaataactctagcaccctctagtgacaaattccgtgaaaaatattttcagtttactctccaagaaaagtaataatcactaccaaaaaacactttgaaggaaaaaaaaaatgtggtgttgtcaacataccacatcactaattcttatcatagctagtgatctctctggctgcatctcttggcctttctactggttttctcttaggcttcaacacaatattcctgttttttatatcatctaaattatgtcccactcattattttccttgtctccttttcatctcccttttaagtaagagttttttttctagcattcattttttgttaccagttttttcttctctttttcttatgctttcaaagatctcattcattcattcatttctattatcttcattctagtagtggccaaatctgtgtatctctattctcatctttttccatatctccagttgcctgttgggtaattccacagacatgccctactgtgtccttaaacacaacattatgaaagccttccttatctttcctcactgtcagcattcacatttttattagtgataccccctttccaagcaggcagcaaagcttagaagcttgacattcttttcattctccctcatcccatagccttcaaacacaccatgcatatgtatgcctgtgtaactgctttatctcttatcctgtctggaaagacctgagaattattctccaatgatctaagcttctcctttagggtactgcttaaataccaccacatcctggaatctttttgtgacaagtctagctcatcttgatctttctccgtagccatgactgtctttattacacactttgacatttaattttatttctggttatgatacactcctgagagcttcctattgtaaaagattaggtgttgcctttataactaaattgtagattatcttttttttttgagacggagtctcgctctgttgccaagctggagtgtagtggtgtgatcttggcccactgcaacctccaactccctggttcaagcaatactcctgcctcagcctcccaagtatctgggattacaggcacaatgccaatacgcccagctaatttttgtatttttagtagagacggggtttcaccatgttggccagactggtctcgatctcttgaccttgtgatcagcctgactcggcctcccaaagtgctgggattataggcatgagccaccgcgcctggcctgtagattatcttttttaaagacagagagtcttccatatacttcttttaaaacttcagtagtatctagcaccatgctaggcacaaagcagaaaattagtaaatactttttgaataggattaaatagaatgagtcatgtatcttagcaagaggaataaatacaataccacaaacgttcactaccagatggccccaaaaagaagaaaagtacttcttgtctagattatattttgtagttaacaaaagtaacatataggagatatttctgaatattttgttttgcaaccacaaatttaataactgttaggattattgtcaaaatactagttgaatctcttatggaactagaaatgtcatgggttagcaccaatctcaaagaatatttctggacatttttatatcatgaagagatttttggctttcctggcactatagacagtcttctggacctctggtgatcagccctcctggccctgtgtggtctgtagtgtatcctgggaatagactcctcacatcctgttcacacctgggagacaaatctcagcctcctatcttcacaccacttctcctgaatcacaggctggtgtcttctcatctgccttgctccactcctttctgatatctgctcagaggaccctttagataatcatcatggacagtcacacatggagagtaaggattcagaatgattcttctttactcagctatcctgtgactgtctccaatctctttaaaatgacatttgtgtgacatcctagagaagaaacaatgaaattgaatgccagcagtgtcctggtgtttataggtggaatacacatattatgtcatataaatagttgaaaaaacttgaagttgattcgttatagaacttgcccccaaatcaaatagctaacaatctatacactgtagagccagatctgacaccagaagctattttgcttccatttggccatgtgggctgcctattggttcttttttaaaacaaaatagctggccagatgcagtggctcacgtctgtaatcccaacactttggaaagctgaggtaggtggatcgcttgagctcaggagtttgagaccagcctggccaacatggtgaaaccctatctctgctaaaaatacaaaaaaaaaaaaaaaaaaattagttgggcatgatggcacacagctgttgtctcagctactcgggagtctgaggcggcagaatcacccaagctaagggagattgcctacactccagcgtaggcaatctgagtgagaccctgtttcacatacatacatacatacatacataaaacaaaatagctaagtttaattgaatacttttctgacagacactgtctgtggtaaattgtttgctggcatttatttcattcaatccttatgaattaggaagtattattagtcctgtattactgatgagaaaactgaggtctaaaaaggttaattaatttgcccaaatacaaaacagacagtaattgatggaattagaattcaaacataggtctacctcacaccagagcctgagccttcaaccaccatgctctgacatctttttaacattgtgctattcattttgttctatccaattaaataccaatacctgacacccagaaaagtttttgctttaacatctaagaaattattatttaaatctgccacatctcctttgcagaacaacaagaattaataaagttttttaaaagtttcaattcagtggagcaattaacataaaatggttttattttgccccagtcattgttttaaatcattctccaccagctctccctcttgtttctcttagtgccatttcggtaagagcccataactttcagttcactcattcttttaatattcttttaattaaatacctaacatatgctaggcattattctgagtgctgagaatacatcagtgaacaacaattaaacatctgtgcagttcaaaatgttatatccaattcaaatgtcatgtcctctccctgcagtaggagaggcctgcagtagcagttagagaaaacccatctgttcttttactctttctctgaagctagcactttgaggaatttggggggaaatgtttggctcgactctgagaaacctcctccctctttttgttaaagactacttcttcaaatacgttggagaaaagaaggaagggcatggaaaagggcaaacatctcttttattaactcgattattaactccactaattctctctggcagggtccaaatctggccctctgatgtaggatgtctggcttcagcctagcttccttacacttcttcaggtccccagggatgcagaggcctcctctgctatggccgcttgaccttggaaactcatgtacccataccagatccactgatgggaatgtatacagcttacagccaccctgtctgtctggctctccctttcccattctcttctctgcttaagtacacatacctataactgctcacgctgaggaggggaaaagaatgccccccagtctttccttgaggacaccataagcctttaagaaggagtagcatgcaccaagaagaggggaggaaaaagccactacattacccagtaggccaaaccatggttccagcaaatttccctgcctctcactagctcagccttctggaagggggtggctgtggtttgtggggttggcagggctgattctactttctgaggtagatggcaagccccacttgtttggtgacttcctgatagtgtggaatagttaacgtatctttgtcctgaagtttgggaccctgatgaccaattctagggcaaacatcctgttacaaaggcaagaaattaatgagttaaatgatgagtttattataaaattatggtcaacaccctacaattatatgttataatattttgtataatatgtagagcaatactaatcaaacaaatagttatactagtaactttacctccttctcctttccatcttacctctgcctaaatgtccctggtcagaagtccttagtcaccgacgggatttaactccaaactccttttttgacattgataatgctccagtccttatttctgtacccagaccctctgctcccccaggtcaggacacttgggcctgctgagtccagctcacacacaactctgcctttggtctgactctgttttttgtctgaaatgcctacctactttctgtttgtctaactccaggctttcctgtaggtttgcctttcaagccactgtgcactataaggccttccagaactgctcttcctctggatttcttagcacccacatttcaccattagcctaagccgtcttctctttcagcgttctctttttcttcccgtactctgttaccttactaaattatacatctctcaaggacaataacacttttcttaagcttctccgtagtgttatgcttgttcagtgcatatatgtttgctgatggcaaagaataatattttggaaataatttcatgatttaaaaatctaaaagatattaagatatactgaaaaataagtatttgattatttaaaatgttacaaaagaggaaggtttcctactccctctctgcatccacattttcatggaacaaaggcctaggtataagctgatttagatttgcccccatctagaaatttaatcaaagtcttagagctggagagaacatcagggttactgagtctccctctctgccttagggttcaatacaaaatttaacactgtttgatttggaactagggaatggtttggggacagtaaatgttgaggctaattaggtgatttagataatccagagtctgtgtaaaattaaaatcctatttgtagtgagactctgaactagctttctcagccttttgctctacctcctgcacaagaatatgactcagagctgggagtaatggcatgcttagccttggatagctgtcctcctctgctttcaggatccattttcattactctatcatcttcctctttctttcttttcttttcccttgttcccctaatgtatcaattggaaagtatctagcatttcatggtacaatagaaaaggaagtggactaaaaggaaacctagattctattcccatctttttcaccaattatgtgatctcaaccaccaccacaccactctgggcttatttctttgttgatagaagtggggatgaaattaggtaatcatattaatgtcactggtttttgtatagaccattatatgtaaccgttcacttagttattggcgtacccaccacattgtatcgtgtgaagtataaacactttttttctttctttttttcataaggttatagctcagcaagtgtcagataaacacttggaagagggtcggctttatcctcctttgaataccattagagatgtttctctgaaaattgcagaaaaggtaaaaccactcttgttcaagcttcattatttttccttccttttcttgctaaatatgcatttttaaatattaaaaatctgcttccttgaaatgtatatctgtatcaacttactatgtcagaagtcagagaaatgaggcacactgacactgtagagcttaggagctacatttgcttctcagagaagaatggaagtattgggccgaataattaatttccctctctatcgttctttttttctcctaaaatttaaataattcattagggcttcctgtcagccagatttctcccatttcacctttttaaagttgttcttttctatatcacattagtgataattaaccaaaatattacagatatgttagagtaacatttagaccttgaaccaccttccatatccatgtcactatgatgtgtggcatcataaatgacagatcacaactgataatactgggcggaaggcaaaataaagaggtcaaagaacttgaaagctgtttgggtggcagatgagctactgaaggagttagccaagaagaacccaaaggcagagaaattttctgtaactaaactggaagataagtggactttttttgcagtgtaattgtattagttttcttgggctgggataactacataccacggttatgtagtaactgtttttaaatattcaagccacagactgtgtggcttaaacaacagaaaactattttcccataattctgggagctagaagtctaagataaagatgtttgcaggtttggtttcctctgaggcctctctccttggctggcagatggctgccctctttctgtgtccccatatggccttttctctgtgtgtgtacacgcttgtgtgtccaaatttcctcttctcttaaggacacctatcaaattggattatagaccattctaaccgtctcattttaacttaattatctccttaaaggcctatttctaaatacactcacattctgaggtactagtggttagggcttcaacactgaatttggggtgggaggaacacagtttagccatgacagtagttatatgtttaaattggggtttctctacttcagcgttgtggacattttgggtcaataaccatcatgcggctgtcccaggcattgtacaatcttcagcagcattcctggcctctgcccactagatgtcagtagcatctgctcagttgtatcaaccaaagctgtttccagacattgtcaagtatccccttgggggccaaattgctccagattgaaaatcactagcttaagctattagcaagttatctaaacaacaccatttaagagtcacatatcattatttatctcgttgactgaaggcagtctcttaaaaaaagaagtaattctctaaaaacctttacataataatctgcttggttatctatgaaaaagtatgttcatatattctactaatatgtatctgctagtttttaagtagtttaaactattaatatactgaatagcatattatcattttaagttcattttggagatttaaatgaaaaagagttagcttatgattagaggggaaaaaaagcaggggacagcaggggagtgccaaaagattcagatatcacacctagaataatggaagaatacagagtgcatacacagaaattgagaaactagaacaaagaaccaacttcagagagggagatcatgtaagtggactgcaagtttgaggtatcaatggcacattcaaatgtaccattttatcaagtagatagaaatgactgaaacttaaagagaggctagataaaagacctgggcatcttctgcatgtggtaactggtgaatatctaggagtgggtgaggttgccaagaaagcaagtatagaaaggaaataaaaatgagaatagaatatagtttattattctgtctagaagacagaagaaagatgccagttaagaagagaagtggtcaggattttaagagactccaaactgagcagcatgtcaataattaggaaagagacaatttcagaatgggagtggaaattgtgaccaacacagccaaatcctggagagaaaaacagatgcagacttttatttggtacttaacaagttatcagagacttttacaaaagaaatttcaagatgtacaggaggttcagaaggcagagaattaggaaagcaataaaatataagccactctgtcagagagtttggcattgacaggacagagagagtgaagatttcattgggagaagggattatttctatggtataactgggagcagaaagaggagatgaatttccacatagtctatgtcagtaatgaaacaatgtgttttattataaaattaacatagccatcttaagtaggcatgagggatctttttggggtgatggaaatattctaaaactgaatgtggtaatattgttgcacagctcagtaaatttacaaaaataatttagttgtacacttaaaatgcttgaattttgtgtgaattatatctcaataaatctgtttaaaaagtaatactaccatattatgggcactttggaaaacaaatagagaaaaggaaaataaccaatatcctatttttctaatataagtattattttttttcctgtgtttgttttgagtctttcgtttgtttattttctaacattattataattatgaaatatacatattgtttcctgctttttcatagacatttcataatacagcacagtattcataaccttaattgttcataaatgcatagttttacattgagatgagataatcattctgatattctttgaaatcagacttatcaaaataagtcagtcatataaatattgttttaagaactgatgtgaattcggctgggcacggtggctcacacctgtaatcccagcacttcgggaggccaaggcaggtggatcacctcaggtcaggagtttgagaccagactggccaacatggcgaaaccccttctcttctaaaaaagtacagaaattagccgggtgtggtggcaggagcctgttaacccttgggaggctgaggcaggagaatcgcttgtttttttgttgttgttgttttttgttttgttttgtttcgtttttgagatggagttttgctcttgttgcccaggctagagtacaatggtgtgatctcggctcactgcaacctctgcctcccgggttcaagtgattctcttgcctcagcctcccgagtagctagggttacaggcatgcaccaccacacccggctaattttgtatttttagtagagatggggtttctccatgttggtcaggctggtcttgaactcctgacctcaggtgatccacctgcctcggcctcccaaagtgctgggattacaggcatgagccactgtgccagccagagaatcgcttgaacccaggaggcagaggttgcagtgagctgagatcgtgccactgcactccaacctgggtgacagagtaagactccatctcaaaaaaaaaaaaaaactggtgtgaattaaatagtatatatgaagtgattaattttgatgaagagaatccatttaaagaaagtagggaaagagaagatgtatgaagacactgaggagatagtctgagttggtcaaaagggaaattaaggtcattttctctgagtagttgaaattttctcccatgatgtgatatgatgatgtgattctccagtgagtgatgagagtcaaatggaagcttgaagatgggggaaggtttggaattgctttttgggaaccacaagaggaagttttaagtaaagagagaaaaaagtataatgtgcagactagaaaaaaaatatagcaccacagaaagtttactgcatcgttctaggatgcacagccacaaaaggagaaagccagctctgaggggtccccagacgagggactagaattatgcatgaaacacagggcgtgatgaccagagaatctgtgacgctggcaaagagtgctcatcctgactgtggtgtctagatgattagctgagcaagatcaggagaccctggggtacaggaagagattttgtaggaggctgtggtgagaatagggattcttgaaaattcaaggttcaagtttagcaggactatttaggtatttatttcaagttaattgtcagtcaggtcatgtcaagactttgaacactggcttctctgagaaatccagatgtgatagtacttgaatcagtctcacctggtcacactttccttagttgctgatgtcatttttctctctcactatatgatttataattgcattttcattttatatcttcattgcttatatgtgcttttattataatacacttaatgtttttgcaaacataggatacagtgtttttgaaatggataaaaacttccactcacatgggctcatgattacctctatttattaaaataattaatattcttttcttatatctagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgacataaccaacattaaaactcataattattttgttgaccattttgttaaaatctacttttc

SEQ ID NO: 36530 - DNA, 219524 bp, Homo sapiens; identical to SEQ ID NO: 36529
